US012668612B2

(12) United States Patent
Hoeben et al.

(10) Patent No.: US 12,668,612 B2
(45) Date of Patent: Jun. 30, 2026

(54) ONCOLYTIC NON-HUMAN ADENOVIRUSES AND USES THEREOF

(71) Applicant: ACADEMISCH ZIEKENHUIS LEIDEN (H.O.D.N. LUMC), Leiden (NL)

(72) Inventors: Rob Cornelis Hoeben, Leiden (NL); Selas Bots, Leiden (NL); Vera Kemp, Leiden (NL)

(73) Assignee: ACADEMISCH ZIEKENHUIS LEIDEN (H.O.D.N. LUMC), Leiden (NL)

( * ) Notice: Subject to any disclaimer, the term of this patent is extended or adjusted under 35 U.S.C. 154(b) by 1064 days.

(21) Appl. No.: 17/625,483

(22) PCT Filed: Jul. 7, 2020

(86) PCT No.: PCT/NL2020/050443
§ 371 (c)(1),
(2) Date: Jan. 7, 2022

(87) PCT Pub. No.: WO2021/006730
PCT Pub. Date: Jan. 14, 2021

(65) Prior Publication Data
US 2022/0281921 A1 Sep. 8, 2022

(30) Foreign Application Priority Data
Jul. 9, 2019 (NL) ...................................... 2023464

(51) Int. Cl.
| C07K 14/005 | (2006.01) |
| A61P 35/00 | (2006.01) |
| C12N 7/00 | (2006.01) |
| A61K 38/00 | (2006.01) |

(52) U.S. Cl.
CPC ............ *C07K 14/005* (2013.01); *A61P 35/00* (2018.01); *C12N 7/00* (2013.01); *A61K 38/00* (2013.01); *C12N 2710/10321* (2013.01); *C12N 2710/10322* (2013.01); *C12N 2710/10332* (2013.01)

(58) Field of Classification Search
CPC ................... C07K 14/005; C12N 7/00; C12N 2710/10321
See application file for complete search history.

(56) References Cited

U.S. PATENT DOCUMENTS

| 7,989,425 | B2 | 8/2011 | Sung et al. |
| 8,673,319 | B2 | 3/2014 | Colloca et al. |
| 9,133,483 | B2 | 9/2015 | Wilson et al. |
| 9,359,618 | B2 | 6/2016 | Roy et al. |
| 9,593,346 | B2 | 3/2017 | Roy et al. |
| 9,597,363 | B2 | 3/2017 | Roy et al. |
| 9,617,561 | B2 | 4/2017 | Roy et al. |
| 10,113,182 | B2 | 10/2018 | Roy et al. |
| 10,149,873 | B2 | 12/2018 | Roy et al. |
| 2015/0071962 | A1* | 3/2015 | Roy et al. ............. C12N 15/86 424/199.1 |

FOREIGN PATENT DOCUMENTS

| EP | 2325298 | B2 | 5/2011 | |
| WO | 2009/073103 | A2 | 6/2009 | |
| WO | WO2010051367 | A1 * | 5/2010 | ............... C12N 7/00 |
| WO | 2010/138675 | A1 | 12/2010 | |
| WO | 2012/024351 | A2 | 2/2012 | |
| WO | 2019/086450 | A1 | 5/2019 | |
| WO | 2019/086456 | A1 | 5/2019 | |
| WO | 2019/086461 | | 5/2019 | |
| WO | 2019/086466 | A1 | 5/2019 | |

OTHER PUBLICATIONS

Rux et al. (2004) "Adenovirus structure" Human gene therapy, 15(12), 1167-1176. (Year: 2004).*
Bots et al. (2022) "Nonhuman primate adenoviruses of the human adenovirus B species are potent and broadly acting oncolytic vector candidates" Human Gene Therapy, 33(5-6), 275-289. (Year: 2022).*
Office Action for European Patent Application No. 20740097.9 (Dated Sep. 15, 2023).
International Search Report and Written Opinion for corresponding Application No. PCT/NL2020/050443 (mailed Nov. 2, 2020).
Cheng et al., "A Novel Oncolytic Adenovirus Based on Simian Adenovirus Serotype 24," Oncotarget 8 (16):26871-26885 (2017).
Chiu, J et al: "Site-directed, Ligase-Independent Mutagenesis (SLIM): A Single-tube Methodology Approaching 100% Efficiency in 4 h," Nucleic Acids Res 32(21):e174 (2004).
Arnberg et al., "Adenovirus Type 37 Uses Sialic Acid as a Cellular Receptor on Chang C Cells." Journal of Virology, 76(17):8834-8841 (2002).
Arnberg, Niklas "Adenovirus Receptors: Implications for Tropism, Treatment and Targeting," Reviews in Medical Virology 25(1):2-23 (2015).
Barnadas et al., "Molecular Epidemiology of Human Adenovirus Infections in Denmark, 2011-2016," Journal of Clinical Virology 104:16-22 (2018).
Bauer et al., "Detection of Antibodies Against Adenovirus Protein IX, Fiber, and Hexon in Human Sera by Immunoblot Assay," Journal of Clinical Microbiology 43(9):4426-4433 (2005).

(Continued)

*Primary Examiner* — James Joseph Graber
(74) *Attorney, Agent, or Firm* — Troutman Pepper Locke, LLP (Rochester)

(57) ABSTRACT

Novel nucleic acid sequences, vectors and adenoviral genomes are provided herein. Corresponding novel adenoviruses and genotypes and compositions are also provided. The novel nucleic acid sequences, vectors, genomes, adenoviruses, genotypes and compositions are useful in therapy. The novel nucleic acid sequences, vectors, genomes, adenoviruses, genotypes and compositions are particularly useful in treating or preventing cancer.

14 Claims, 11 Drawing Sheets

Specification includes a Sequence Listing.

(56)                    References Cited

OTHER PUBLICATIONS

Cappuccini et al., "Immunogenicity and Efficacy of the Novel Cancer Vaccine Based on Simian Adenovirus and MVA Vectors Alone and in Combination With PD-1 mAb in a Mouse Model of Prostate Cancer," Cancer Immunology, Immunotherapy 65(6):701-713 (2016).

Cervera-Carrascon et al., "TNFa and IL-2 Armed Adenoviruses Enable Complete Responses by Anti-PD-1 Checkpoint Blockade," OncoImmunology 7(5):1-11 (2018).

Engeland et al., "CTLA-4 and PD-L1 Checkpoint Blockade Enhances Oncolytic Measles Virus Therapy," Molecular Therapy 22(11):1949-1959 (2014).

Filley and Dey, "Immune System, Friend or Foe of Oncolytic Virotherapy?" Frontiers in Oncology 7:1-8 (2017).

Gaggar et al., "CD46 is a cellular receptor for group B adenoviruses," Nature Medicine, 9(11), 1408-1412 (2003).

Grekova et al., "Activation of a Glioma-specific Immune Response by Oncolytic Parvovirus Minute Virus of Mice Infection," Cancer Gene Therapy 19(7):468-475 (2012).

Grossardt et al., "Granulocyte-Macrophage Colony-Stimulating Factor-Armed Oncolytic Measles Virus Is an Effective Therapeutic Cancer Vaccine," Human Gene Therapy 24(7):644-654 (2013).

Heise et al., "ONYX-015, an EIB Gene-attenuated Adenovirus, Causes Tumor-specific Cytolysis and Antitumoral Efficacy That Can be Augmented by Standard Chemotherapeutic Agents," Nature Medicine (44):398-399 (1997).

Hoppe et al., "Multiple Cross-species Transmission Events of Human Adenoviruses (HAdV) During Hominine Evolution," Molecular Biology and Evolution 32(8):2072-2084 (2015).

Kaufman et al., "Oncolytic Viruses: A New Class of Immunotherapy Drugs," Nature Reviews Drug Discovery 14(9):642-662 (2015).

Kleijn et al., "The In Vivo Therapeutic Efficacy of the Oncolytic Adenovirus Delta24-RGD is Mediated by Tumor-specific Immunity," PLoS ONE 9(5):e97495 (2014).

Larson et al., "Going Viral: A Review of Replication-selective Oncolytic Adenoviruses," Oncotarget 6(24):19976-89 (2015).

Lion et al., "Adenovirus Infections in Immunocompetent and Immunocompromised Patients," Clinical Microbiology Reviews 27(3):441-462 (2014).

Lynch et al., "Adenovirus: Epidemiology, Global Spread of Novel Serotypes, and Advances in Treatment and Prevention," Seminars in Respiratory and Critical Care Medicine 37(4):586-602 (2016).

Madisch et al., "Phylogenetic Analysis and Structural Predictions of Human Adenovirus Penton Proteins as a Basis for Tissue-Specific Adenovirus Vector Design," Journal of Virology 81(15):8270-8281 (2007).

Martin et al., "Pre-surgical Neoadjuvant Oncolytic Virotherapy Confers Protection Against Rechallenge in a Murine Model of Breast Cancer," Scientific Reports 9(1):1865 (2019).

Mostafa et al., "Oncolytic Reovirus And Immune Checkpoint Inhibition as a Novel Immunotherapeutic Strategy for Breast Cancer," Cancers 10(6):1-18 (2018).

Pantó et al., "Taxonomy Proposal for Old World Monkey Adenoviruses: Characterisation of Several Non-human, Non-ape Primate Adenovirus Lineages," Archives of Virology 160(12):3165-3177 (2015).

Raja et al., "Oncolytic Virus Immunotherapy: Future Prospects for Oncology," Journal for ImmunoTherapy of Cancer 6(1):140 (2018).

Shashkova et al., "Characterization of Human Adenovirus Serotypes 5, 6, 11, and 35 as Anticancer Agents," Virology 394:311-320 (2009).

Short et al., "Members of Adenovirus Species B Utilize CD80 and CD86 as Cellular Attachment Receptors," Virus Research 122(1-2):144-153 (2006).

Shtrichman and Kleinberger, "Adenovirus Type 5 E4 Open Reading Frame 4 Protein Induces Apoptosis in Transformed Cells Adenovirus Type 5 E4 Open Reading Frame 4 Protein Induces Apoptosis in Transformed Cells," Journal of Virology 72(4):2975-82 (1998).

Vogels et al., "Replication-Deficient Human Adenovirus Type 35 Vectors for Gene Transfer and Vaccination: Efficient Human Cell Infection and Bypass of Preexisting Adenovirus Immunity," Journal of Virology,77(15):8263-8271 (2003).

Wang et al., "Desmoglein 2 is a Receptor for Adenovirus Serotypes 3, 7, 11, and 14," Nature Medicine 17(1):96-104 (2011).

Zhang et al., "Adenovirus Receptors," Journal of Virology 79(19):12125-12131 (2005).

Zhao et al., "Seroprevalence of Neutralizing Antibodies Against Human Adenovirus Type-5 and Chimpanzee Adenovirus Type-68 in Cancer Patients," Frontiers in Immunology 9:335 1-9 (2018).

Thomas et al., "Immunosuppression Enhances Oncolytic Adenovirus Replication And Anti Tumor Efficacy in the Syrian Hamster Model," Mol Ther. 16:1665-1673 (2008).

Bredenbeek et al., "A Stable Full-length Yellow Fever Virus cDNA Clone and the Role of Conserved RNA Elements in Flavivirus Replication," J Gen Virol 84:1261-1268 (2003).

Hanahan et al., "Studies on Transformation of Escherichia coli With Plasmids," J Mol Biol 166(4):557-580 (1983).

Kong et al. "An Efficient In Vivo Recombination Cloning Procedure for Modifying and Combining HSV-1 Cosmids," J Virol Methods 80(2):129-136 (1999).

Fallaux et al., "Characterization of 911: A New Helper Cell Line for the Titration and Propagation of Early Region 1-deleted Adenoviral Vectors," Hum Gene Ther 7(2):215-222 (1996).

Stolarek et al., "Robust Infectivity and Replication of Delta-24 Adenovirus Induce Cell Death in Human Medulloblastoma," Cancer Gene Ther 11:713-720 (2004).

García-Nafría et al., "Iva Cloning: A Single-Tube Universal Cloning System Exploiting Bacterial in Vivo Assembly," Sci Rep 6:27459 (2016).

Whyte et al., "Two Regions of the Adenovirus Early Region 1A Proteins Are Required For Transformation." J. Virol.62:257-265 (1988).

Horwitz, M.S., "Function of Adenovirus E3 Proteins and Their Interactions With Immunoregulatory Cell Proteins," J Gene Med 6:S172-S183 (2004).

Suzuki et al., "The Presence of the Adenovirus E3 Region Improves the Oncolytic Potency of Conditionally Replicative Adenoviruses," Clin. Cancer Res. 8:3348-3359 (2002).

Singh et al., "Homologous Recombination in E3 Genes of Human Adenovirus Species D," J Virol. 87:12481-12488 (2013).

Bagchi et al., "The Retinoblastoma Protein Copurifies With E2F-I, an E1A-regulated Inhibitor of the Transcription Factor E2F," Cell 65:1063-72 (1991).

Bandara et al., "Adenovirus E1a Prevents the Retinoblastoma Gene Product From Complexing With a Cellular Transcription Factor," Nature 351:494-497 (1991).

Chellappan et al., "Adenovirus E1A, Simian Virus 40 Tumor Antigen, and Human Papillomavirus E7 Protein Share the Capacity to Disrupt the Interaction Between Transcription Factor E2F and the Retinoblastoma Gene Product," Proc. Natl. Acad. Sci. (U. S. A.) 89(10):4549-53 (1992).

Avvakumov et al., "Comprehensive Sequence Analysis of the E1A Proteins of Human and Simian Adenoviruses," Virology 329:477-492 (2004).

Fueyo et al., "A Mutant Oncolytic Adenovirus Targeting the Rb Pathway Produces Anti-glioma Effect In Vivo," Oncogene 19(1):2-12 (2000).

Whyte et al., "Cellular Targets for Transformation by the Adenovirus E1A Proteins," Cell 56:67-75 (1989).

Examination Report issued for Australian Patent Application No. 2020310037, dated Feb. 28, 2025.

Roy et al., "Complete Nucleotide Sequences and Genome Organization of Four Chimpanzee Adenoviruses", Virology 324:361-372 (2004).

Roy et al., "Characterization of a family of chimpanzee adenoviruses and development of molecular clones for gene transfer vectors", Human Gene Therapy 15:519-530 (2004).

Roy et al., "Generation of an Adenoviral Vaccine Vector Based on Simian Adenovirus 21", Journal of General Virology 87:2477-2485 (2006).

(56)           References Cited

OTHER PUBLICATIONS

Roy et al., "Isolation and Characterization of Adenoviruses Persistently Shed from the Gastrointestinal Tract of Non-Human Primates", PLoS Pathogens 5(7):e1000503 (2009).

Wevers et al., "A Novel Adenovirus of Western Lowland Gorillas (Gorilla gorilla gorilla)," Virology Journal 7 (303): 1-8 (2010).

McVey et al., "Adenoviruses Isolated from Wild Gorillas Are Closely Related to Human Species C Viruses", Virology 444:119-123 (2013).

Malouli et al., "Full Genome Sequence Analysis of a Novel Adenovirus of Rhesus Macaque Origin Indicates a New Simian Adenovirus Type and Species", Virol Rep 3-4:18-29 (2014).

Uusi-Kerttula et al., "Oncolytic Adenovirus: Strategies and Insights for Vector Design and Immune-Oncolytic Applications", Viruses 7:6009-6042 (2015).

Priority Search Report and Written Opinion for Application No. NL2023464 dated Feb. 20, 2020.

International Preliminary Report on Patentability Application No. PCT/NL2020/050443 (mailed Jan. 20, 2022).

\* cited by examiner

| Virus | Subgroup | IVIg-dilution-50% |
|---|---|---|
| HAdV5 | C | 1/128 - 1/256 |
| NHP-002 | C | 1/128 - 1/256 |
| NHP-005 | C | 1/256 - 1/512 |
| NHP-006 | B | 1/4 - 1/8 |
| NHP-007 | B | 1/8 - 1/16 |
| NHP-008 | C | 1/256 - 1/512 |
| NHP-012 | B | 1/8 - 1/16 |

FIGURE 3 (continued)

ONCOLYTIC NON-HUMAN ADENOVIRUSES AND USES THEREOF

This application is a national stage application under 35 U.S.C. § 371 of PCT Application No. PCT/NL2020/050443, filed Jul. 7, 2020, which claims the benefit of NL 2023464, filed Jul. 9, 2019, which are hereby incorporated by reference in their entirety.

The present invention provides novel nucleic acid sequences, vectors, adenoviruses, genotypes, genomes and compositions for use in therapy, particularly for use in treating or preventing cancer.

BACKGROUND

Cancer is still one of the leading causes of mortality and as such, in need for more effective and precise treatments. Technological advances in genetic modification have resulted in a renewed interest in the use of viruses and virus-derived vectors in oncolytic virotherapy. A wide variety of viruses are being considered for use as oncolytic agents. Among these, human adenoviruses are regularly used and have many features that make their use very attractive. These include their narrow host range, their efficient replication in human cells, their acceptable safety profile, robust technology for generating genetically modified variants, the availability of efficient and scalable production systems and their safety profile upon administration.

Their safety profile is supported by the observations that a large fraction of the human population has been exposed to human adenoviruses, as evidenced by the presence of humoral immunity (i.e. the presence of circulating antibodies). Adenoviruses are highly prevalent with a seroprevalence up to 99% and as a consequence most people have acquired immunity to these viruses (Bauer et al., 2005; Vogels et al., 2003). The immunity is often serotype-specific with the prevalence varying with each of the serotypes.

In immunocompetent individuals, adenoviral infection is in most cases self-limited and demonstrates with mild flu-like symptoms (Lion, 2014). In patients with a compromised immune function the consequences can be more severe. In addition, some serotypes are associated with conjunctivitis and occasionally outbreaks of ocular adenoviruses can manifest as epidemic keratoconjunctivitis.

Oncolytic viruses (OV) are viruses that preferentially replicate in and lyse transformed cells. These viruses either naturally infect cancerous cells or are genetically reengineered to restrict their replication to tumor cells (Larson et al., 2015). Oncolytic viruses mediate tumor killing not merely via virus-induced lysis of the target cell but rather via the release of cancer-specific antigens and subsequent activation of the immune system (Filley & Dey, 2017; Kaufman, Kohlhapp, & Zloza, 2015). The importance of the latter has been supported by mouse models where it was shown that intra-tumoral administration of oncolytic viruses can affect distant, secondary tumors, as well as prevent tumor formation in re-challenge experiments (Grekova, et al., 2012; Grossardt et al., 2013; Kleijn et al., 2014). In addition, combining oncolytic viruses with immune modulatory drugs have superior and occasional synergistic effects as compared to either therapy alone (Cervera-Carrascon et al., 2018; Engeland et al., 2014; Mostafa et al., 2018). Together, these results illustrate that oncolytic virus therapy can lead to the establishment of an immune memory against the tumor which could target the primary tumor as well as metastases. It appears that oncolytic viruses have different potential depending on the tumor type and heterogeneity, and the tumor microenvironment (reviewed by Raja et al., 2018). In fact, a recent study comparing five different oncolytic viruses within one tumor model demonstrated clear discrepancies between viruses in their potential for oncolysis and the induction of an immune response against the tumor (Martin et al., 2019).

The first genetically modified adenovirus-derived oncolytic agent to be approved in the world has been a human adenovirus that harbours a deletion of the E1B55 kDa (Heise et al., 1997). More adenoviruses are being evaluated and may reach approval soon.

Human adenoviruses are classified in the genus mastadenovirus of the Adenoviridae, which comprises of several genera each with a well-defined and often narrow host range. Despite the narrow host range of individual viruses, distinct adenoviruses occur in primates, bovines, canines, birds, bats, fish, and reptiles (Hoeben & Uil, 2013; Van der Vliet & Hoeben, 2006). Human adenoviruses are nonenveloped viruses with a linear, double-stranded DNA genome ranging from 34 to 37 kB in size. Human adenoviruses (HAdVs) can be divided into seven species or subgroups (A-G) which are further subdivided into approximately 67 types, initially based on serology and more recently on whole genome sequences (Lion, 2014). There is a global diversity in the prevalence of human adenovirus types, with some types being more prevalent than others (Berk, 2007; Wold and Horwitz, 2007; Lynch & Kajon, 2016). The host range of human adenoviruses is generally restricted to one host species and guided by the entry receptor(s) used (reviewed by Arnberg, 2015). Most types bind to the coxsackievirus and adenovirus receptor (CAR), except for subgroup B, D, F and G viruses, which are more promiscuous. Particular types of HAdV-B and HAdV-D can bind complement receptor CD46, Desmoglein 2, Sialic acids, or CD80/CD86 (Arnberg et al., 2002; Gaggar et al., 2003; Short et al., 2006; Wang et al., 2011).

Attachment to the entry receptor is mediated by the "knob" domain of the fiber protein upon which secondary interactions are established via the 'RGD loop' of the penton base protein. This eventually leads to clathrin-mediated uptake of the virion into the host cell (Zhang & Bergelson, 2005). Progeny virus is released by lysis of the cell, attributing to the oncolytic potential of the virus (Shtrichman & Kleinberger, 1998). It should be noted that although replication of HAdV is not inherently restricted to cancer cells, modifications like the E1B-55K or the E1A-delta24 deletion can be used to generate viruses that are tumor cell selective (reviewed in Larson et al., 2015).

HAdV-5 is most often explored for use as a viral vector and oncolytic virus. HAdV-5 is one of the most prevalent adenoviruses in the human population and a majority of people exhibits neutralizing immunity (Vogels et al., 2003). HAdV-5-derived oncolytic viruses have demonstrated strong oncolytic potency in vitro and in vivo preclinical models. While the initial in vitro and in vivo pre-clinical experiments demonstrated the safety and the efficacy of the oncolytic virus approach, the results from clinical studies have been more moderate and variable. (Toth & Wold, (2010) Viruses 2: 1844-1866; Thomas et al., Mol Ther. 2008; 16:1665-1673). Although it is tempting to speculate that this is attributable to a major extent to varying levels of neutralizing immunity between the patients, the small number of patients included in most studies, the variations in the administration routes used, and the varying oncolytic virus doses applied in the studies thwarts an estimation of the impact of neutralizing immunity on anti-tumor efficacy of oncolytic virus therapy. In addition, there is a scarcity of accessible data on the presence of pre-existing immunity in the patients enrolled in these studies.

Most neutralizing antibodies (nAbs) are directed against the major capsid proteins which include hexon, fiber and penton base (Bauer et al., 2005). Attempts to circumvent population immunity to adenoviruses have been made by i.e. employing naturally occurring rare human serotypes or reengineering high prevalent serotypes to evade immune neutralization (Barnadas et al., 2018; Shashkova, May, & Barry, 2010). Although elegant, these strategies are laborious and may affect the production and physical stability of the resulting viruses and so far, this approach did not yield novel oncolytic viruses.

There is a need for new oncolytic viruses for use as anticancer agents.

BRIEF SUMMARY OF THE DISCLOSURE

The inventors have studied the potential use of non-human primate (NHP) adenoviruses in oncolytic virus therapy.

In phylogenetic analysis, NHP adenoviruses cluster in the human adenovirus groups based on DNA and protein similarity. In addition, non-human primates are sensitive to human adenovirus infection (Hoppe et al., 2015; Roy et al., 2009). In fact, there is evidence suggesting that some human adenoviruses may be derived from cross-species transfer of ape adenoviruses (Hoppe et al., 2015; Pantó et al., 2015). Nevertheless, the adenoviruses isolated from non-human primates have hexon, fiber, and penton-base sequences that strongly differ from the homologous sequences from adenoviruses isolated from humans.

Moreover, NHP adenoviruses are thought to have low seroprevalence in the human population as there is generally limited interaction between humans and primates that could lead to frequent transfer of viruses. The low prevalence of neutralizing antibodies would permit for a longer susceptibility window for gene delivery and vaccination. Indeed, recent data from Zhao et al. (2018) showed a much lower prevalence of neutralizing antibodies against a chimpanzee adenoviral vector than against HAdV-5 in a variety of cancer patients. In line with this, the use of a chimpanzee adenoviral vector in a therapeutic vaccine-targeting cancer cells in prostate cancer showed promising results in combination with immune checkpoint inhibitor PD-1 in vivo (Cappuccini et al., 2016). Besides the positive clinical outcomes observed in these studies, a homogenous population immunity will presumably reduce the overall therapeutic variability seen in clinical studies with HAdV-5. So far, the exploration of NHP adenoviruses has been almost completely restricted to their use as vectors in gene and vaccine delivery. In a proof of concept study, Cheng et al. (2017) were able to demonstrate oncolytic potency of the chimpanzee adenovirus AdC7 (that is Simian Adenovirus 24, of subgroup E) in vitro and in vivo. Taken together, it seems imperative that non-human primate adenoviruses are suitable for use as viral oncolytic agents in human cancer therapy. These new adenovirus vectors may constitute new oncolytic agents that may find a niche in a non-immune human patient population, and therefore their use may have a more reproducible and more clinical therapeutic efficacy.

The cellular arm of the immune system is involved in clearing adenovirus-infected cells. The adenovirus E3 transcription unit encodes a varying number of small distinct proteins (usually around 7) that are involved in immune modulation (Horwitz, M. S.: J Gene Med (2004) 6: S172-S183). The presence of the E3 region enhances the persistence and the potency of oncolytic adenoviruses (Suzuki et al., Clin. Cancer Res. (2002) 8: 3348-3359). The role and impact of the E3 genes in immune evasion is evident from the occurrence of homologous recombination events that exchanged E3 region, or parts thereof, between viruses of human adenoviruses of subgroup D in a manner that is similar to the events described between the major capsid protein genes encoding penton base, hexon, and fiber (Singh et al., J Virol. (2013) 87: 12481-12488).

The inventors have isolated and sequenced several new adenoviruses from non-human primates (NHP), gorilla, chimpanzee, bonobo and orangutan. Advantageously, they have shown that the new viruses differ from each of the 67 types of adenoviruses isolated from humans and all published sequences of adenoviruses isolated from non-human primates. They have also shown that they replicate in human cells and can be produced on standard human adenovirus-production cells.

The adenoviruses (Ads) were tested on a panel of 29 human tumor cells from glioblastoma, prostate cancer, bladder cancer and pancreatic cancer to determine whether they could be used as viral oncolytic agents in human cancer therapy. The oncolytic profile of each adenovirus was studied. Advantageously, the observed oncolytic profiles allow a more personalized treatment approach in which patients can be matched to optimal treatment strategies with preselected viruses and specific immune modulatory regimens. Furthermore, the prevalence of neutralizing immunity to the NHP Ads will be lower than that of the neutralizing immunity against human variants. As a result, humans exposed to the novel NHP-Ads described herein should generate more reproducible and predictable clinical responses than those exposed to human Ads.

In one aspect, the invention provides an isolated nucleic acid sequence encoding a hexon polypeptide comprising an amino acid sequence having at least 95% identity to: amino acid residues 139 to 455 of SEQ ID NO: 23; amino acid residues 139 to 452 of SEQ ID NO: 57; or amino acid residues 139 to 453 of SEQ ID NO: 93.

Suitably, the hexon polypeptide may comprise the amino acid sequence of amino acid residues 139 to 455 of SEQ ID NO: 23; amino acid residues 139 to 452 of SEQ ID NO: 57; or amino acid residues 139 to 453 of SEQ ID NO: 93.

Suitably, the hexon polypeptide may comprise the amino acid sequence of SEQ ID NO: 23; SEQ ID NO: 57, or SEQ ID NO: 93.

In another aspect, the invention provides an isolated nucleic acid sequence encoding a fiber polypeptide comprising an amino acid sequence having at least 95% identity to at least one of: amino acid residues 128 to 322 of SEQ ID NO: 22; amino acid residues 75 to 127 of SEQ ID NO: 22; amino acid residues 1 to 74 of SEQ ID NO: 22; amino acid residues 128 to 321 of SEQ ID NO: 56; amino acid residues 75 to 127 of SEQ ID NO: 56; amino acid residues 1 to 74 of SEQ ID NO: 56; amino acid residues 127 to 320 of SEQ ID NO: 92; amino acid residues 74 to 126 of SEQ ID NO: 92; or amino acid residues 1 to 73 of SEQ ID NO: 92.

Suitably, the fiber polypeptide may comprise the amino acid sequence of at least one of: amino acid residues 128 to 322 of SEQ ID NO: 22; amino acid residues 75 to 127 of SEQ ID NO: 22; amino acid residues 1 to 74 of SEQ ID NO: 22; amino acid residues 128 to 321 of SEQ ID NO: 56; amino acid residues 75 to 127 of SEQ ID NO: 56; amino acid residues 1 to 74 of SEQ ID NO: 56; amino acid residues 127 to 320 of SEQ ID NO: 92; amino acid residues 74 to 126 of SEQ ID NO: 92; or amino acid residues 1 to 73 of SEQ ID NO: 92.

Suitably, the fiber polypeptide may comprise the amino acid sequence of SEQ ID NO: 22, 56 or 92.

In another aspect, the invention provides an isolated nucleic acid sequence encoding a penton base polypeptide comprising an amino acid sequence having at least 95% identity to SEQ ID NO: 26, 60 or 96.

Suitably, the penton base polypeptide may comprise the amino acid sequence of SEQ ID NO: 26, 60 or 96.

In another aspect, the invention provides an isolated nucleic acid sequence encoding a hexon polypeptide of the invention and:

(i) a fiber polypeptide of the invention;
(ii) a penton base polypeptide of the invention; or
(iii) a fiber polypeptide of the invention and a penton base polypeptide of the invention.

Suitably, the nucleic acid may encode:

(i) a hexon polypeptide comprising the amino acid sequence of SEQ ID NO:23, a fiber polypeptide comprising the amino acid sequence of SEQ ID NO:22 and optionally a penton base polypeptide comprising the amino acid sequence of SEQ ID NO:26;
(ii) a hexon polypeptide comprising the amino acid sequence of SEQ ID NO:57, a fiber polypeptide comprising the amino acid sequence of SEQ ID NO: 56 and optionally a penton base polypeptide comprising the amino acid sequence of SEQ ID NO: 60; or
(iii) a hexon polypeptide comprising the amino acid sequence of SEQ ID NO: 93, a fiber polypeptide comprising the amino acid sequence of SEQ ID NO: 92 and optionally a penton base polypeptide comprising the amino acid sequence of SEQ ID NO: 96.

Suitably, the sequence may be selected from the group consisting of:

(a) a nucleic acid sequence of SEQ ID NO: 1 and its complement;
(b) a nucleic acid sequence of SEQ ID NO: 36 and its complement; and
(c) a nucleic acid sequence of SEQ ID NO: 71 and its complement.

In another aspect, the invention provides a vector comprising a nucleic acid sequence according to the invention.

In another aspect, the invention provides a polypeptide encoded by a nucleic acid sequence according to the invention.

In another aspect, the invention provides an isolated non-human primate adenovirus having a capsid comprising a capsid polypeptide of at least one of:

(a) a hexon polypeptide comprising an amino acid sequence having at least 95% identity to: amino acid residues 139 to 455 of SEQ ID NO: 23; amino acid residues 139 to 452 of SEQ ID NO: 57; or amino acid residues 139 to 453 of SEQ ID NO: 93;
(b) a hexon polypeptide comprising the amino acid sequence of amino acid residues 139 to 455 of SEQ ID NO: 23; amino acid residues 139 to 452 of SEQ ID NO: 57; or amino acid residues 139 to 453 of SEQ ID NO: 93;
(c) a hexon polypeptide comprising the amino acid sequence of SEQ ID NO: 23, 57, or 93;
(d) a fiber polypeptide comprising an amino acid sequence having at least 95% identity to at least one of: amino acid residues 128 to 322 of SEQ ID NO: 22; amino acid residues 75 to 127 of SEQ ID NO: 22; amino acid residues 1 to 74 of SEQ ID NO: 22; amino acid residues 128 to 321 of SEQ ID NO: 56; amino acid residues 75 to 127 of SEQ ID NO: 56; amino acid residues 1 to 74 of SEQ ID NO: 56; amino acid residues 127 to 320 of SEQ ID NO: 92; amino acid residues 74 to 126 of SEQ ID NO: 92; or amino acid residues 1 to 73 of SEQ ID NO: 92;
(e) a fiber polypeptide comprising the amino acid sequence of at least one of: amino acid residues 128 to 322 of SEQ ID NO: 22; amino acid residues 75 to 127 of SEQ ID NO: 22; amino acid residues 1 to 74 of SEQ ID NO: 22; amino acid residues 128 to 321 of SEQ ID NO: 56; amino acid residues 75 to 127 of SEQ ID NO: 56; amino acid residues 1 to 74 of SEQ ID NO: 56; amino acid residues 127 to 320 of SEQ ID NO: 92; amino acid residues 74 to 126 of SEQ ID NO: 92; or amino acid residues 1 to 73 of SEQ ID NO: 92;
(f) a fiber polypeptide comprising the amino acid sequence of SEQ ID NO: 22, 56 or 92;
(g) a penton base polypeptide comprising an amino acid sequence having at least 95% identity to SEQ ID NO: 26, 60 or 96; or
(h) a penton base polypeptide comprising the amino acid sequence of SEQ ID NO: 26, 60 or 96.

Suitably, the capsid may comprise a hexon polypeptide selected from (a) to (c) and a fiber polypeptide selected from (d) to (f), and optionally a penton base polypeptide selected from (g) to (h).

Suitably, the capsid polypeptide may be selected from a hexon polypeptide comprising an amino acid sequence SEQ ID NO: 23; a fiber polypeptide comprising an amino acid sequence SEQ ID NO: 22; and a penton base polypeptide comprising an amino acid sequence SEQ ID NO: 26.

Suitably, the capsid may comprise a hexon polypeptide comprising an amino acid sequence SEQ ID NO: 23; and a fiber polypeptide comprising an amino acid sequence SEQ ID NO: 22; and optionally a penton base polypeptide comprising an amino acid sequence SEQ ID NO: 26.

Suitably, the capsid protein may be selected from a hexon polypeptide comprising an amino acid sequence of SEQ ID NO: 57; a fiber polypeptide comprising an amino acid sequence of SEQ ID NO: 56; and a penton base polypeptide comprising an amino acid sequence of SEQ ID NO: 60.

Suitably, the capsid may comprise a hexon polypeptide comprising an amino acid sequence of SEQ ID NO: 57; and a fiber polypeptide comprising an amino acid sequence of SEQ ID NO: 56; and optionally a penton base polypeptide comprising an amino acid sequence of SEQ ID NO: 60.

Suitably, the capsid protein may be selected from a hexon polypeptide comprising an amino acid sequence of SEQ ID NO: 93; a fiber polypeptide comprising an amino acid sequence of SEQ ID NO: 92; and a penton base polypeptide comprising an amino acid sequence of SEQ ID NO: 96.

Suitably, the capsid may comprise a hexon polypeptide comprising an amino acid sequence of SEQ ID NO: 93; and a fiber polypeptide comprising an amino acid sequence of SEQ ID NO: 92; and optionally a penton base polypeptide comprising an amino acid sequence of SEQ ID NO: 96.

Suitably, the adenovirus may be conditionally replicative.
Suitably, the adenovirus may lack:
(a) all or a part of the E1 gene; and/or
(b) all or part of the E1A gene; optionally wherein the E1A has a Δ24 deletion.

Suitably, the adenovirus may further comprise the left-hand and right-hand side adenovirus cis-elements necessary for replication and encapsidation, optionally wherein the cis-elements necessary for replication and encapsidation comprise an adenovirus left-hand side inverted terminal repeat and an adenovirus right-hand side inverted terminal repeat, and encapsidation signals.

In another aspect, the invention provides an isolated non-human primate adenovirus genotype comprising the adenovirus of the invention.

In another aspect, the invention provides an isolated non-human primate adenovirus genome encoding the adenovirus of the invention.

In another aspect, the invention provides a pharmaceutical composition comprising an adenovirus, genome, isolated nucleic acid sequence, vector or protein of any preceding claim, and a pharmaceutically acceptable excipient, adjuvant, diluent and/or carrier.

In another aspect, the invention provides a composition according to the invention for use in targeting a cell having an adenoviral receptor in a subject.

In another aspect, the invention provides a composition according to the invention for use in therapy.

In another aspect, the invention provides a composition for use according the invention, wherein the composition is for use in treating or preventing cancer.

In another aspect, the invention provides a method for targeting a cell having an adenoviral receptor in a subject, the method comprising administering a composition of the invention to the subject.

In another aspect, the invention provides a method of treating a subject comprising administering a composition of the invention to the subject.

Suitably, the method is for treating or preventing cancer.

In another aspect, the invention provides an isolated nucleic acid sequence encoding a hexon polypeptide comprising an amino acid sequence having at least 95% identity to: amino acid residues 137 to 452 of SEQ ID NO: 129; amino acid residues 137 to 452 of SEQ ID NO: 163; or amino acid residues 139 to 456 of SEQ ID NO: 197.

Suitably, the hexon polypeptide may comprise the amino acid sequence of amino acid residues 137 to 452 of SEQ ID NO: 129; amino acid residues 137 to 452 of SEQ ID NO: 163; or amino acid residues 139 to 456 of SEQ ID NO: 197.

Suitably, the hexon polypeptide may comprise the amino acid sequence of SEQ ID NO: 129, SEQ ID NO: 163, or SEQ ID NO: 197.

In another aspect, the invention provides an isolated nucleic acid sequence encoding a fiber polypeptide comprising an amino acid sequence having at least 95% identity to at least one of: amino acid residues 388 to 577 of SEQ ID NO: 128; amino acid residues 76 to 387 of SEQ ID NO: 128; amino acid residues 1 to 75 of SEQ ID NO: 128; amino acid residues 392 to 581 of SEQ ID NO: 162; amino acid residues 76 to 391 of SEQ ID NO: 162; amino acid residues 1 to 75 of SEQ ID NO: 162; amino acid residues 391 to 580 of SEQ ID NO: 196; amino acid residues 76 to 390 of SEQ ID NO: 196; or amino acid residues 1 to 75 of SEQ ID NO: 196.

Suitably, the fiber polypeptide may comprise the amino acid sequence of at least one of: amino acid residues 388 to 577 of SEQ ID NO: 128; amino acid residues 76 to 387 of SEQ ID NO: 128; amino acid residues 1 to 75 of SEQ ID NO: 128; amino acid residues 392 to 581 of SEQ ID NO: 162; amino acid residues 76 to 391 of SEQ ID NO: 162; amino acid residues 1 to 75 of SEQ ID NO: 162; amino acid residues 391 to 580 of SEQ ID NO: 196; amino acid residues 76 to 390 of SEQ ID NO: 196; or amino acid residues 1 to 75 of SEQ ID NO: 196.

Suitably, the fiber polypeptide may comprise the amino acid sequence of SEQ ID NO: 128, 162 or 196.

In another aspect, the invention provides an isolated nucleic acid sequence encoding a penton base polypeptide comprising an amino acid sequence having at least 95% identity to SEQ ID NO: 132, 166 or 200.

Suitably, the penton base polypeptide may comprise the amino acid sequence of SEQ ID NO: 132, 166 or 200.

In another aspect, the invention provides an isolated nucleic acid sequence encoding a hexon polypeptide of the invention and:
(i) a fiber polypeptide of the invention;
(ii) a penton base polypeptide of the invention; or
(iii) a fiber polypeptide of the invention and a penton base polypeptide of the invention.

Suitably, the nucleic acid may encode:
(i) a hexon polypeptide comprising the amino acid sequence of SEQ ID NO:129, a fiber polypeptide comprising the amino acid sequence of SEQ ID NO:128 and optionally a penton base polypeptide comprising the amino acid sequence of SEQ ID NO:132;
(ii) a hexon polypeptide comprising the amino acid sequence of SEQ ID NO:163, a fiber polypeptide comprising the amino acid sequence of SEQ ID NO: 162 and optionally a penton base polypeptide comprising the amino acid sequence of SEQ ID NO: 166; or
(iii) a hexon polypeptide comprising the amino acid sequence of SEQ ID NO: 197, a fiber polypeptide comprising the amino acid sequence of SEQ ID NO: 196 and optionally a penton base polypeptide comprising the amino acid sequence of SEQ ID NO: 200.

Suitably, the sequence may be selected from the group consisting of:
(a) a nucleic acid sequence of SEQ ID NO: 106 and its complement;
(b) a nucleic acid sequence of SEQ ID NO: 142 and its complement; and
(c) a nucleic acid sequence of SEQ ID NO: 176 and its complement.

In another aspect, the invention provides a vector comprising a nucleic acid sequence according to the invention.

In another aspect, the invention provides a polypeptide encoded by a nucleic acid sequence according to the invention.

In another aspect, the invention provides an isolated non-human primate adenovirus having a capsid comprising a capsid polypeptide of at least one of:
(a) a hexon polypeptide comprising an amino acid sequence having at least 95% identity to: amino acid residues 137 to 452 of SEQ ID NO: 129; amino acid residues 137 to 452 of SEQ ID NO: 163; or amino acid residues 139 to 456 of SEQ ID NO: 197;
(b) a hexon polypeptide comprising the amino acid sequence of amino acid residues 137 to 452 of SEQ ID NO: 129; amino acid residues 137 to 452 of SEQ ID NO: 163; or amino acid residues 139 to 456 of SEQ ID NO: 197;
(c) a hexon polypeptide comprising the amino acid sequence of SEQ ID NO: 129, 163 or 197;
(d) a fiber polypeptide comprising an amino acid sequence having at least 95% identity to at least one of: amino acid residues 388 to 577 of SEQ ID NO: 128; amino acid residues 76 to 387 of SEQ ID NO: 128; amino acid residues 1 to 75 of SEQ ID NO: 128; amino acid residues 392 to 581 of SEQ ID NO: 162; amino acid residues 76 to 391 of SEQ ID NO: 162; amino acid residues 1 to 75 of SEQ ID NO: 162; amino acid residues 391 to 580 of SEQ ID NO: 196; amino acid residues 76 to 390 of SEQ ID NO: 196; or amino acid residues 1 to 75 of SEQ ID NO: 196;
(e) a fiber polypeptide comprising the amino acid sequence of at least one of: amino acid residues 388 to 577 of SEQ ID NO: 128; amino acid residues 76 to 387 of SEQ ID NO: 128; amino acid residues 1 to 75 of SEQ ID NO: 128; amino acid residues 392 to 581 of SEQ ID NO: 162; amino acid residues 76 to 391 of SEQ ID NO: 162; amino acid residues 1 to 75 of SEQ ID NO: 162; amino acid residues 391 to 580 of SEQ ID NO: 196; amino acid residues 76 to 390 of SEQ ID NO: 196; or amino acid residues 1 to 75 of SEQ ID NO: 196;

(f) a fiber polypeptide comprising the amino acid sequence of SEQ ID NO: 128, 162, or 196;

(g) a penton base polypeptide comprising an amino acid sequence having at least 95% identity to SEQ ID NO: 132, 166, or 200; or (h) a penton base polypeptide comprising the amino acid sequence of SEQ ID NO: 132, 166, or 200.

Suitably, the capsid may comprise a hexon polypeptide selected from (a) to (c) and a fiber polypeptide selected from (d) to (f), and optionally a penton base polypeptide selected from (g) to (h).

Suitably, the capsid polypeptide may be selected from a hexon polypeptide comprising an amino acid sequence SEQ ID NO: 129; a fiber polypeptide comprising an amino acid sequence SEQ ID NO: 128; and a penton base polypeptide comprising an amino acid sequence SEQ ID NO: 132.

Suitably, the capsid may comprise a hexon polypeptide comprising an amino acid sequence SEQ ID NO: 129; and a fiber polypeptide comprising an amino acid sequence SEQ ID NO: 128; and optionally a penton base polypeptide comprising an amino acid sequence SEQ ID NO: 132.

Suitably, the capsid protein may be selected from a hexon polypeptide comprising an amino acid sequence of SEQ ID NO: 163; a fiber polypeptide comprising an amino acid sequence of SEQ ID NO: 162; and a penton base polypeptide comprising an amino acid sequence of SEQ ID NO: 166.

Suitably, the capsid may comprise a hexon polypeptide comprising an amino acid sequence of SEQ ID NO: 163; and a fiber polypeptide comprising an amino acid sequence of SEQ ID NO: 162; and optionally a penton base polypeptide comprising an amino acid sequence of SEQ ID NO: 166.

Suitably, the capsid protein may be selected from a hexon polypeptide comprising an amino acid sequence of SEQ ID NO: 197; a fiber polypeptide comprising an amino acid sequence of SEQ ID NO: 196; and a penton base polypeptide comprising an amino acid sequence of SEQ ID NO: 200.

Suitably, the capsid may comprise a hexon polypeptide comprising an amino acid sequence of SEQ ID NO: 197; and a fiber polypeptide comprising an amino acid sequence of SEQ ID NO: 196; and optionally a penton base polypeptide comprising an amino acid sequence of SEQ ID NO: 200.

Suitably, the adenovirus may be conditionally replicative.

Suitably, the adenovirus may lack:

(a) all or a part of the E1 gene; and/or (b) all or part of the E1A gene; optionally wherein the E1A has a Δ24 deletion.

Suitably, the adenovirus may further comprise the left-hand and right-hand side adenovirus cis-elements necessary for replication and encapsidation, optionally wherein the cis-elements necessary for replication and encapsidation comprise an adenovirus left-hand side inverted terminal repeat and an adenovirus right-hand side inverted terminal repeat, and encapsidation signals.

In another aspect, the invention provides an isolated non-human primate adenovirus genotype comprising the adenovirus of the invention.

In another aspect, the invention provides an isolated non-human primate adenovirus genome encoding the adenovirus of the invention.

In another aspect, the invention provides a pharmaceutical composition comprising an adenovirus, genome, isolated nucleic acid sequence, vector or protein of any preceding claim, and a pharmaceutically acceptable excipient, adjuvant, diluent and/or carrier.

In another aspect, the invention provides a composition according to the invention for use in targeting a cell having an adenoviral receptor in a subject.

In another aspect, the invention provides a composition according to the invention for use in therapy.

In another aspect, the invention provides a composition for use according the invention, wherein the composition is for use in treating or preventing cancer.

In another aspect, the invention provides a method for targeting a cell having an adenoviral receptor in a subject, the method comprising administering a composition of the invention to the subject.

In another aspect, the invention provides a method of treating a subject comprising administering a composition of the invention to the subject.

Suitably, the method is for treating or preventing cancer.

Throughout the description and claims of this specification, the words "comprise" and "contain" and variations of them mean "including but not limited to", and they are not intended to (and do not) exclude other moieties, additives, components, integers or steps.

Throughout the description and claims of this specification, the singular encompasses the plural unless the context otherwise requires. In particular, where the indefinite article is used, the specification is to be understood as contemplating plurality as well as singularity, unless the context requires otherwise.

Features, integers, characteristics, compounds, chemical moieties or groups described in conjunction with a particular aspect, embodiment or example of the invention are to be understood to be applicable to any other aspect, embodiment or example described herein unless incompatible therewith.

The patent, scientific and technical literature referred to herein establish knowledge that was available to those skilled in the art at the time of filing. The entire disclosures of the issued patents, published and pending patent applications, and other publications that are cited herein are hereby incorporated by reference to the same extent as if each was specifically and individually indicated to be incorporated by reference. In the case of any inconsistencies, the present disclosure will prevail.

Unless defined otherwise herein, all technical and scientific terms used herein have the same meaning as commonly understood by one of ordinary skill in the art to which this invention pertains. For example, Singleton and Sainsbury, Dictionary of Microbiology and Molecular Biology, 2d Ed., John Wiley and Sons, NY (1994); and Hale and Marham, The Harper Collins Dictionary of Biology, Harper Perennial, NY (1991) provide those of skill in the art with a general dictionary of many of the terms used in the invention. Although any methods and materials similar or equivalent to those described herein find use in the practice of the present invention, the preferred methods and materials are described herein. Accordingly, the terms defined immediately below are more fully described by reference to the Specification as a whole. Also, as used herein, the singular terms "a", "an," and "the" include the plural reference unless the context clearly indicates otherwise. Unless otherwise indicated, polynucleotides are written left to right in 5' to 3' orientation;

amino acid sequences are written left to right in amino to carboxy orientation, respectively. It is to be understood that this invention is not limited to the particular methodology, protocols, and reagents described, as these may vary, depending upon the context they are used by those of skill in the art.

Various aspects of the invention are described in further detail below.

BRIEF DESCRIPTION OF THE DRAWINGS

Embodiments of the invention are further described hereinafter with reference to the accompanying drawings, in which.

DETAILED DESCRIPTION

Figure 1:
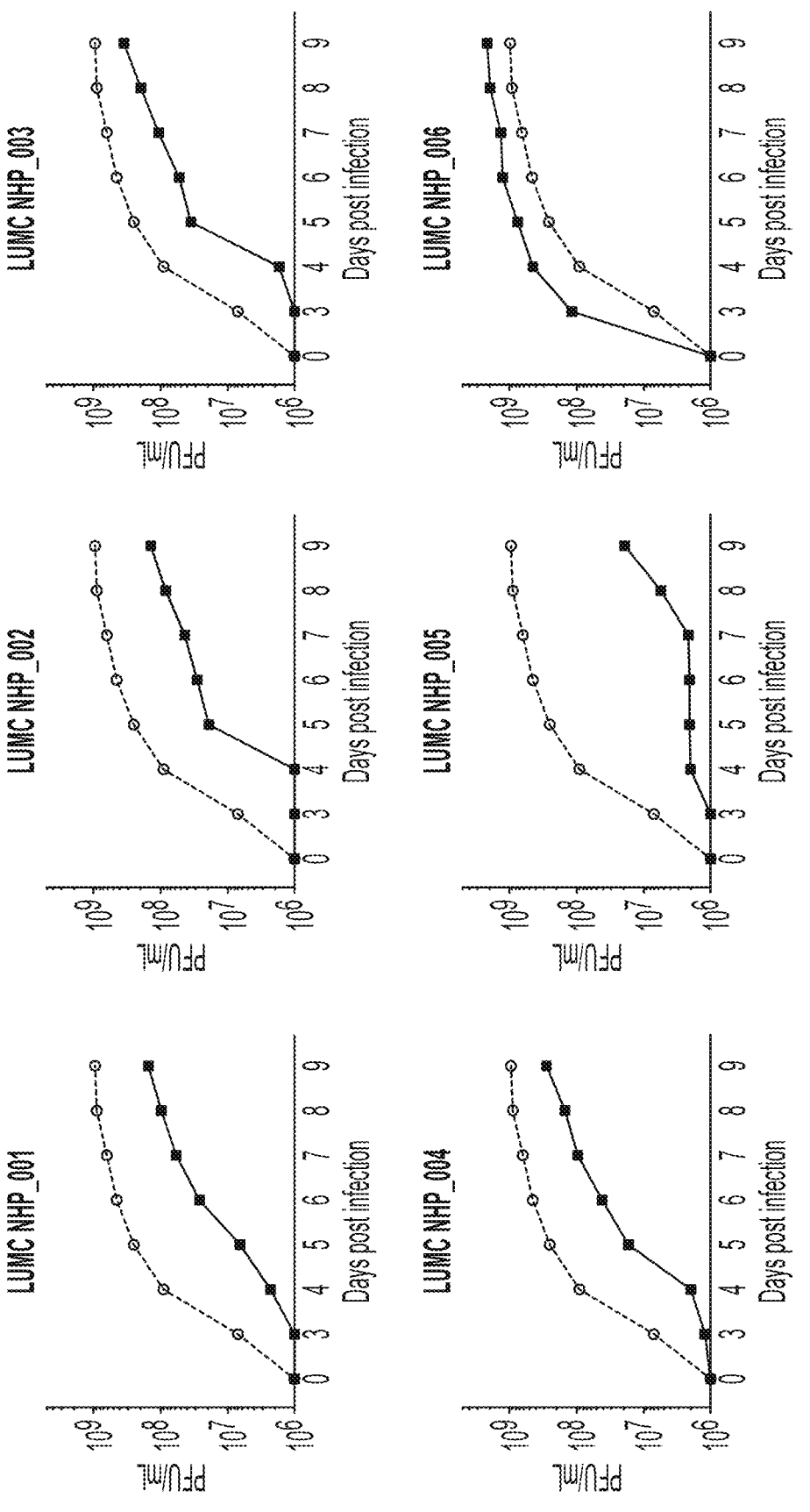
FIG. 1 shows development of viral plaques over time on human HER911 cells in monolayer culture. The cultures were exposed to various concentrations of each of the 12 isolated NHP-Ads (solid lines). The development of viral plaques was monitored every day for 9 days. All of the viruses produced plaques on the HER911 cells and the titers of the stocks varied between 3×10E7 and 2×10E9 plaque-forming units/mL. The plaques developed with kinetics similar to the control wtHAdV5 (dashed lines).
Figure 1:
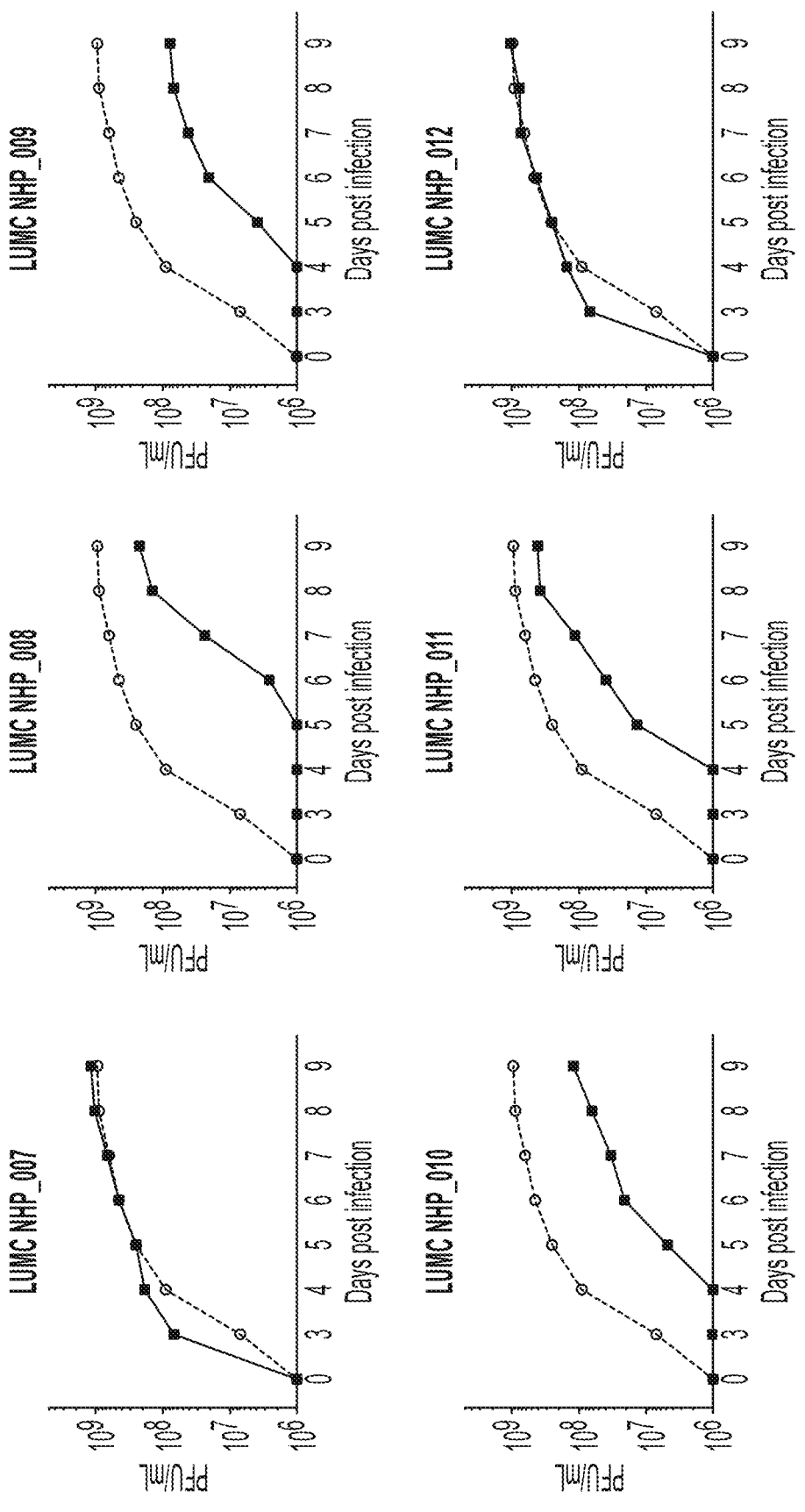

The present invention provides novel nucleic acid sequences, vectors, adenoviruses, genotypes, genomes and compositions for use in therapy, particularly for use in treating or preventing cancer.

The term "nucleic acid" as used herein typically refers to an oligomer or polymer (preferably a linear polymer) of any length composed essentially of nucleotides. A nucleotide unit commonly includes a heterocyclic base, a sugar group, and at least one, e.g. one, two, or three, phosphate groups, including modified or substituted phosphate groups. Heterocyclic bases may include inter alia purine and pyrimidine bases such as adenine (A), guanine (G), cytosine (C), thymine (T) and uracil (U) which are widespread in naturally-occurring nucleic acids, other naturally-occurring bases (e.g., xanthine, inosine, hypoxanthine) as well as chemically or biochemically modified (e.g., methylated), non-natural or derivatised bases. Sugar groups may include inter alia pentose (pentofuranose) groups such as preferably ribose and/or 2-deoxyribose common in naturally-occurring nucleic acids, or arabinose, 2-deoxyarabinose, threose or hexose sugar groups, as well as modified or substituted sugar groups. Nucleic acids as intended herein may include naturally occurring nucleotides, modified nucleotides or mixtures thereof. A modified nucleotide may include a modified heterocyclic base, a modified sugar moiety, a modified phosphate group or a combination thereof. Modifications of phosphate groups or sugars may be introduced to improve stability, resistance to enzymatic degradation, or some other useful property. The term nucleic acid further preferably encompasses DNA, RNA and DNA RNA hybrid molecules, specifically including hnRNA, pre-mRNA, mRNA, cDNA, genomic DNA, amplification products, oligonucleotides, and synthetic (e.g., chemically synthesised) DNA, RNA or DNA RNA hybrids. A nucleic acid can be naturally occurring, e.g., present in or isolated from nature; or can be non-naturally occurring, e.g., recombinant, i.e., produced by recombinant DNA technology, and/or partly or entirely, chemically or biochemically synthesised. A nucleic acid can be double-stranded, partly double stranded, or single-stranded. In adenoviruses the linear nucleic acid that forms the viral genome typically have polypeptides derived from the precursor of the terminal protein (pTP) covalently coupled to each of the 5' ends of the polynucleotide chain. Where single-stranded, the nucleic acid can be the sense strand or the antisense strand. In addition, nucleic acid can be circular or linear. The terms "polynucleotide" and "oligonucleotide" are used interchangeably and refer to a polymeric form of nucleotides of any length, either deoxyribonucleotides or ribonucleotides or analogs thereof.

The terms "peptide", "protein" and "polypeptide" are used interchangeably herein. The N-terminus of a protein (also known as the amino-terminus, NH2-terminus, N-terminal end or amine-terminus) is the start of a protein or polypeptide terminated by an amino acid with a free amine group (—NH2). By convention, peptide sequences are written N-terminus to C-terminus (from left to right). The C-terminus (also known as the carboxyl-terminus, carboxy-terminus, C-terminal tail, C-terminal end, or COOH-terminus) is the end of an amino acid chain (protein or polypeptide), terminated by a free carboxyl group (—COOH).

Certain sequences provided herein are described using percent identity to a sequence with a defined amino acid or nucleic acid sequence. To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes may be at least 70%, 75%, 80%, 82%, 84%, 85%, 86%, 87%, 88%, 89%, 90%, 91%, 92%, 93%, 94%, 95%, 96%, 97%, 98%, 99%, or 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. Preferably, the percent identity between two amino acid sequences is determined using the Needleman et al. (1970) J. Mol. Biol. 48:444-453) algorithm which has been incorporated into the GAP program in the GCG software package (available at www.gcg-.com), using either a BLOSUM 62 matrix or a PAM250 matrix, and a gap weight of 16, 14, 12, 10, 8, 6, or 4 and a length weight of 1, 2, 3, 4, 5, or 6. Preferably, the percent identity between two nucleotide sequences is determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a sequence identity or homology limitation of the invention) are a BLOSUM 62 scoring matrix with a gap penalty of 12, a gap extend penalty of 4, and a frameshift gap penalty of 5.

Alternatively, the percent identity between two amino acid or nucleotide sequences can be determined using the algorithm of Meyers et al. (1989) CABIOS 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) J. Mol. Biol. 215: 403-410). BLAST nucleotide searches can be performed with the NBLAST program, score=100, wordlength=12 to obtain nucleotide sequences homologous to nucleic acid molecules of the invention. BLAST protein searches can be performed with the XBLAST program, score=50, wordlength=3 to obtain amino acid sequences homologous to protein molecules of the invention. To obtain gapped alignments for comparison purposes, gapped BLAST can be utilized as described in Altschul et al. (1997, Nucl. Acids Res. 25:3389-3402). When using BLAST and gapped BLAST programs, the default parameters of the respective programs (e.g., XBLAST and NBLAST) can be used. See www.ncbi.nlm.nih.gov.

A polynucleotide or polynucleotide region (or a polypeptide or polypeptide region) has a certain percentage (for example, 70%, 75%, 80%, 85%, 90%, 95%, 96%, 97%, 98%, 99% or 100%) of "sequence identity" to another sequence. This means that, when aligned, that percentage of bases (or amino acids) are the same in comparing the two sequences. This alignment and the percent homology or sequence identity can be determined using software programs known in the art, for example those described in Ausubel et al. eds. (2007) Current Protocols in Molecular Biology. Preferably, default parameters are used for alignment. One alignment program is BLAST, using default parameters. In particular, programs are BLASTN and BLASTP, using the following default parameters: Genetic code=standard; filter=none; strand=both; cutoff=60; expect=10; Matrix=BLOSUM62; Descriptions=50 sequences; sort by=HIGH SCORE; Databases=non-redundant, GenBank+EMBL+DDBJ+PDB+GenBank CDS translations+SwissProtein+SPupdate+PIR. Details of these programs can be found at the following Internet address: ncbi.nlm.nih.gov/cgi-bin/BLAST. The terms "xx % sequence identity" and "xx % identity" are used interchangeably herein.

The term "isolated" as used herein refers to a nucleic acid, polypeptide or an adenovirus that is not in its natural environment. The nucleic acid, polypeptide or adenovirus may therefore be of synthetic origin (or alternatively, of natural original, but isolated from its natural environment). Accordingly, when the nucleic acids, polypeptides or adenoviruses are present e.g. in a pharmaceutical composition (comprising adjuvants etc.) they are considered to be in isolated form, as they are not in their natural environment. Nucleic acid sequences and/or amino acid sequences are also considered to be "isolated" when they are not functionally linked with the rest of the genome/proteome environment that they are naturally found in.

The term "vector" is well known in the art, and as used herein refers to a nucleic acid molecule, e.g. double-stranded DNA. In one example, the vector has an exogenous nucleic acid sequence inserted into it. A vector can suitably be used to transport an inserted nucleic acid molecule into a suitable host cell. A vector typically contains all of the necessary elements that permit transcribing the insert nucleic acid molecule, and, preferably, translating the transcript into a polypeptide. A vector typically contains all of the necessary elements such that, once the vector is in a suitable host cell, the vector can replicate independently of, or coincidental with, the host chromosomal DNA; several copies of the vector and its inserted nucleic acid molecule may be generated. Vectors of the present invention can be episomal vectors (i.e., that do not integrate into the genome of a host cell), or can be vectors that integrate into the host cell genome. This definition includes both non-viral and viral vectors. Non-viral vectors include but are not limited to plasmid vectors (e.g. pMA-RQ, pUC vectors, bluescript vectors (pBS) and pBR322 or derivatives thereof that are devoid of bacterial sequences (minicircles)) transposons-based vectors (e.g. PiggyBac (PB) vectors or Sleeping Beauty (SB) vectors), etc. Larger vectors such as artificial chromosomes (bacteria (BAC), yeast (YAC), or human (HAC)) may be used to accommodate larger inserts. In one particular example, a vector described herein may therefore be a plasmid vector. Such plasmid vectors may be present within a cell. In one example, therefore a cell may be provided which comprises a vector (e.g. a plasmid as described herein) comprising a nucleic acid sequence described herein. A cell may therefore be provided comprising a nucleic acid sequence of the invention.

A vector as defined herein may also be a viral vector. A "viral vector" is defined as a recombinantly produced virus or viral particle that comprises a polynucleotide to be delivered into a host cell, either in vivo, ex vivo or in vitro. Examples of viral vectors include retroviral vectors, lentiviral vectors, adenovirus vectors, adeno-associated virus vectors (AAV), alphavirus vectors and the like. Typically, but not necessarily, viral vectors are replication-deficient as they have lost the ability to propagate in a given cell since viral genes essential for replication have been eliminated from the viral vector. However, some viral vectors can also be adapted to replicate specifically or preferentially in a given cell, such as e.g. a cancer cell, and are typically used to trigger the (cancer) cell-specific (onco)lysis. These viral vectors are referred to herein as "oncolytic viruses". Virosomes are a non-limiting example of a vector that comprises both viral and non-viral elements, in particular they combine liposomes with an inactivated HIV or influenza virus (Yamada et al., 2003). Another example encompasses viral vectors mixed with cationic lipids.

The present invention provides novel nucleic acid sequences, vectors, adenoviruses, genotypes, genomes and compositions that are typically defined by a nucleic acid or amino acid sequence corresponding to a non-human primate adenoviral capsid protein or a fragment thereof.

A "capsid protein" refers to a protein on the capsid of an adenovirus or a functional fragment or derivative thereof that is involved in determining the serotype and/or tropism of a particular adenovirus. Several capsid proteins exist, including hexon, fiber and penton base.

A "hexon polypeptide" as used herein refers to the predominant component of the capsid protein of an adenovirus. Also encompassed within this term are functional fragments and derivatives of the hexon polypeptide. The hexon polypeptide comprises "hypervariable regions" (HVRs), which are portions of the polypeptide that vary widely among different adenovirus genotypes and bind to neutralising antibodies. The HVRs can be identified by the amino acid residue positions that they occupy within the hexon polypeptide of the novel hexon polypeptides disclosed herein.

One target of neutralizing antibodies against adenoviruses is the hexon polypeptide. It is possible to replace the hexon polypeptide or the HVRs, with the hexon polypeptide or HVRs from adenoviruses that are rare in the human population, such as the chimpanzee, gorilla, orangutan or bonobo adenovirus sequences described herein. Advantageously, this allows for the construction of adenovirus vectors that would be less susceptible to neutralization by antibodies commonly found in humans.

Whilst the hexon polypeptide is the major capsid protein, another protein present as part of the adenoviral capsid is a fiber polypeptide, which is also a target for neutralizing antibodies against adenoviruses. A "fiber polypeptide" refers to an adenovirus fiber protein, functional fragments, and derivatives thereof. Replacing the fiber protein or variable sequences within the fiber protein (the "knob", "shaft" or "tail" domain) with the fiber protein or variable sequences from adenoviruses that are rare in the human population, such as the bonobo, gorilla, orangutan or chimpanzee adenovirus sequences described herein, can also allow for the construction of adenovirus vectors that would be less susceptible to neutralization by antibodies commonly found in humans. A combination of the fiber replacement with hexon replacements described herein can confer additional resistance to neutralization by antibodies commonly present in human populations.

Yet another polypeptide of the capsid is the penton base polypeptide. The penton-base polypeptides form the vertex capsomer which function as the pentomeric base to which the fiber trimers bind. This polypeptide has been implicated in adenoviral cell entry. A "penton base polypeptide" refers to adenovirus penton base protein, functional fragments, and derivatives thereof.

A "non-human primate adenovirus" as used herein refers to an adenoviruses that are isolated from primates other than humans. Typically non-human primate adenovirus is used to mean simian derived adenoviruses (i.e. those derived from chimpanzees, bonobos, orangutans or gorillas).

"Adenovirus genotype", "adenovirus type" or "adenovirus serotype" as used herein, are used to refer to any adenovirus that can be assigned to any of the currently known member of the Mastadenovirus genus, of which the human isolates are classified into subgroups A-G, and further extends to any, as yet, unidentified or unclassified adenoviral types. See, for example, Strauss, "Adenovirus infections in humans," in The Adenoviruses, Ginsberg, ea., Plenum Press, New York, N.Y., pp. 451-596 (1984) and Shenk, "Adenoviridae: The Viruses and Their Replication," in Fields Virology, Vol. 2, Fourth Edition, Knipe, 35ea., Lippincott Williams & Wilkins, pp. 2265-2267 (2001).

Nucleic Acid Sequences Clustering with Subgroup B Adenoviruses

Hexon Sequences

Isolated nucleic acid sequences are provided herein that encode a hexon polypeptide comprising an amino acid sequence having at least 95% sequence identity to: amino acid residues 139 to 455 of SEQ ID NO: 23; amino acid residues 139 to 452 of SEQ ID NO: 57; or amino acid residues 139 to 453 of SEQ ID NO: 93. These regions of the hexon represent the hypervariable regions of the novel hexons provided herein (i.e. for NHP 007, NHP 012 and NHP 006 respectively).

The isolated nucleic acid sequence may encode a hexon polypeptide comprising an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 455 of SEQ ID NO: 23. Amino acid residues 139 to 455 of SEQ ID NO: 23 correspond to the HVR of novel adenovirus NHP 007 described herein.

For example, the isolated nucleic acid sequence may encode a hexon polypeptide comprising an amino acid sequence having at least 98.5%, at least 99% or 100% identity to SEQ ID NO: 23. In other words, the isolated nucleic acid sequence may encode a hexon polypeptide comprising an amino acid sequence that is identical to SEQ ID NO: 23.

Alternatively, the isolated nucleic acid sequence may encode a hexon polypeptide comprising an amino acid sequence having at least 81%, at least 85%, at least 90%, at least 91%, at least 92%, at least 93%, at least 94%, at least 95%, at least 96%, at least 97%, at least 98%, at least 99% or 100% identity to amino acid residues 139 to 452 of SEQ ID NO: 57. Amino acid residues 139 to 452 of SEQ ID NO: 57 correspond to the HVR of novel adenovirus NHP 012 described herein.

In this example, the isolated nucleic acid sequence may encode a hexon polypeptide comprising an amino acid sequence having at least 99.5% or 100% identity to SEQ ID NO: 57. In other words, the isolated nucleic acid sequence may encode a hexon polypeptide comprising an amino acid sequence that is identical to SEQ ID NO: 57.

In an alternative example, the isolated nucleic acid sequence may encode a hexon polypeptide comprising an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 453 of SEQ ID NO: 93. Amino acid residues 139 to 453 of SEQ ID NO: 93 correspond to the HVR of novel adenovirus NHP 006 described herein.

In this example, the isolated nucleic acid sequence may encode a hexon polypeptide comprising an amino acid sequence having at least 88.5%, at least 89%, at least 90%, at least 91%, at least 92%, at least 93%, at least 94%, 95%, at least 96%, at least 97% at least 98% at least 99% or 100% identity to SEQ ID NO: 93. In other words, the isolated nucleic acid sequence may encode a hexon polypeptide comprising an amino acid sequence that is identical to SEQ ID NO: 93.

Fiber Sequences

Isolated nucleic acid sequences are also provided herein that encode a fiber polypeptide comprising an amino acid sequence having at least 95% sequence identity to at least one of: amino acid residues 128 to 322 of SEQ ID NO: 22; amino acid residues 75 to 127 of SEQ ID NO: 22; amino acid residues 1 to 74 of SEQ ID NO: 22; amino acid residues 128 to 321 of SEQ ID NO: 56; amino acid residues 75 to 127 of SEQ ID NO: 56; amino acid residues 1 to 74 of SEQ ID NO: 56; amino acid residues 127 to 320 of SEQ ID NO: 92; amino acid residues 74 to 126 of SEQ ID NO: 92; or amino acid residues 1 to 73 of SEQ ID NO: 92. The defined amino acid regions for SEQ ID NO: 22 represent the "knob", "shaft" and "tail" domains respectively of the fiber protein for new adenovirus NHP 007 described herein; the defined amino acid regions for SEQ ID NO: 56 represent the "knob", "shaft" and "tail" domains respectively of the fiber protein for new adenovirus NHP 012 described herein; and simi- larly, the defined amino acid regions for SEQ ID NO: 92 represent the "knob", "shaft" and "tail" domains respec- tively of the fiber protein for new adenovirus NHP 006 described herein).

The isolated nucleic acid sequence may encode a fiber polypeptide comprising an amino acid sequence having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, two, or three of: amino acid residues 128 to 322 of SEQ ID NO: 22; amino acid residues 75 to 127 of SEQ ID NO: 22; amino acid residues 1 to 74 of SEQ ID NO: 22. For example, the isolated nucleic acid sequence may encode a fiber polypeptide comprising an amino acid sequence having at least 68% identity to residues 128 to 322 of SEQ ID NO: 22. Alternatively, the isolated nucleic acid sequence may encode sequence having at least 60% identity to residues 75 to 127 of SEQ ID NO: 22. Alternatively, the isolated nucleic acid sequence may encode sequence having at least 83% identity to residues 1 to 74 of SEQ ID NO: 22. For example, the encoded fiber polypeptide may comprise an amino acid sequence having at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 22.

Alternatively, the isolated nucleic acid sequence may encode a fiber polypeptide comprising an amino acid sequence having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 128 to 321 of SEQ ID NO: 56; amino acid residues 75 to 127 of SEQ ID NO: 56; amino acid residues 1 to 74 of SEQ ID NO: 56. For example, the isolated nucleic acid sequence may encode a fiber polypeptide comprising an amino acid sequence having at least 60% identity to residues 128 to 321 of SEQ ID NO: 56. Alternatively, the isolated nucleic acid sequence may encode a fiber polypeptide com- prising an amino acid sequence having at least 61% identity to residues 75 to 127 of SEQ ID NO: 56. Alternatively, the isolated nucleic acid sequence may encode a fiber polypep- tide comprising an amino acid sequence having at least 86% identity to residues 1 to 74 of SEQ ID NO: 56. For example, the encoded fiber polypeptide may comprise an amino acid sequence having at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 56.

In another example, the isolated nucleic acid sequence may encode a fiber polypeptide comprising an amino acid sequence having at least 63%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 127 to 320 of SEQ ID NO: 92; amino acid residues 74 to 126 of SEQ ID NO: 92; or amino acid residues 1 to 73 of SEQ ID NO: 92. Alternatively, the isolated nucleic acid sequence may encode a fiber polypeptide comprising an amino acid sequence having at least 68% identity to residues 127 to 320 of SEQ ID NO: 92. Alternatively, the isolated nucleic acid sequence may encode a fiber polypeptide com- prising an amino acid sequence having at least 63% identity to residues residues 74 to 126 of SEQ ID NO: 92. Alterna- tively, the isolated nucleic acid sequence may encode a fiber polypeptide comprising an amino acid sequence having at least 86% identity to residues 1 to 73 of SEQ ID NO: 92. For example, the encoded fiber polypeptide may comprise an amino acid sequence having at least 71%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 92.

Penton Base

An isolated nucleic acid sequence encoding a penton base polypeptide is also provided, comprising an amino acid sequence having at least 93%, at least 94%, at least 95%, at least 96%, at least 97%, at least 98%, at least 99% or 100% identity to SEQ ID NO: 26. In other words, the isolated nucleic acid sequence may encode penton base polypeptide comprising an amino acid sequence that is identical to SEQ ID NO: 26.

Alternatively, an isolated nucleic acid sequence encoding a penton base polypeptide is also provided, comprising an amino acid sequence having at least 95%, at least 96%, at least 97%, at least 98%, at least 99% or 100% identity to SEQ ID NO: 60. In other words, the isolated nucleic acid sequence may encode penton base polypeptide comprising an amino acid sequence that is identical to SEQ ID NO: 60.

Alternatively, an isolated nucleic acid sequence encoding a penton base polypeptide is also provided, comprising an amino acid sequence having at least 93%, at least 94%, at least 95%, at least 96%, at least 97%, at least 98%, at least 99% or 100% identity to SEQ ID NO: 96. In other words, the isolated nucleic acid sequence may encode penton base polypeptide comprising an amino acid sequence that is identical to SEQ ID NO: 96.

Combinations

An isolated nucleic acid sequence provided herein may include any combination (i.e. at least two, at least three etc) of the individual hexon, penton base and fiber sequences (or fragments thereof e.g. HVRs, shaft, tail and knob etc) provided herein.

Accordingly, a nucleic acid sequence is provided that encodes a hexon polypeptide as defined herein, and at least one of: (i) a fiber polypeptide as defined herein; and (ii) a penton base polypeptide as defined herein. In one example, the nucleic acid sequence encodes a hexon polypeptide as defined herein, and further encodes a fiber polypeptide as defined herein and also a penton base polypeptide as defined herein.

In one example, a nucleic acid sequence provided herein may encode a hexon polypeptide of SEQ ID NO: 23, 57, or 93 and at least one of: (i) a fiber polypeptide of SEQ ID NO: 22, 56 or 92; and (ii) a penton base polypeptide of SEQ ID NO: 26, 60 or 96.

A nucleic acid sequence is therefore provided which encodes a hexon polypeptide of SEQ ID NO: 23, SEQ ID NO: 57, or SEQ ID NO: 93, wherein the nucleic acid sequence further encodes a fiber polypeptide of SEQ ID NO: 22, 56 or 92 and also a penton base polypeptide of SEQ ID NO: 26, 60 or 96.

In one example, the nucleic acid sequence encodes a hexon polypeptide of SEQ ID NO: 23 and at least one of: (i) a fiber polypeptide of SEQ ID NO: 22; and (ii) a penton base polypeptide of SEQ ID NO: 26. For example, the nucleic acid sequence may encode a hexon polypeptide of SEQ ID NO: 23, wherein the nucleic acid sequence further encodes a fiber polypeptide of SEQ ID NO: 22 and also a penton base polypeptide of SEQ ID NO: 26.

In one example, the nucleic acid sequence encodes a hexon polypeptide comprising an amino acid sequence having at least 95% identity to amino acid residues 139 to 455 of SEQ ID NO: 23 and at least one of: (i) a fiber polypeptide comprising an amino acid sequence having at least 95% identity to at least one of: amino acid residues 128 to 322 of SEQ ID NO: 22; amino acid residues 75 to 127 of SEQ ID NO: 22 and/or amino acid residues 1 to 74 of SEQ ID NO: 22; and (ii) a penton base polypeptide comprising an amino acid sequence having at least 95% identity to SEQ ID NO: 26. For example, the nucleic acid sequence may encode a hexon polypeptide comprising an amino acid sequence having at least 95% identity to amino acid residues 139 to 455 of SEQ ID NO: 23, wherein the nucleic acid sequence further encodes a fiber polypeptide comprising an amino acid sequence having at least 95% identity to at least one of: amino acid residues 128 to 322 of SEQ ID NO: 22; amino acid residues 75 to 127 of SEQ ID NO: 22; and/or amino acid residues 1 to 74 of SEQ ID NO: 22; and optionally also a penton base polypeptide comprising an amino acid sequence having at least 95% identity to SEQ ID NO: 26. For example, the nucleic acid sequence may encode a hexon polypeptide comprising amino acid residues 139 to 455 of SEQ ID NO: 23, wherein the nucleic acid sequence further encodes a fiber polypeptide comprising: amino acid residues 128 to 322 of SEQ ID NO: 22; amino acid residues 75 to 127 of SEQ ID NO: 22; and amino acid residues 1 to 74 of SEQ ID NO: 22; and optionally also a penton base polypeptide comprising an amino acid sequence of SEQ ID NO: 26.

In another example, the nucleic acid sequence encodes a hexon polypeptide of SEQ ID NO: 57 and at least one of: (i) a fiber polypeptide of SEQ ID NO: 56; and (ii) a penton base polypeptide of SEQ ID NO: 60. For example, the nucleic acid sequence may encode a hexon polypeptide of SEQ ID NO: 57, wherein the nucleic acid sequence further encodes a fiber polypeptide of SEQ ID NO: 56 and also a penton base polypeptide of SEQ ID NO: 60.

In one example, the nucleic acid sequence encodes a hexon polypeptide comprising an amino acid sequence having at least 95% identity to amino acid residues 139 to 452 of SEQ ID NO: 57 and at least one of: (i) a fiber polypeptide comprising an amino acid sequence having at least 95% identity to at least one of: amino acid residues 128 to 321 of SEQ ID NO: 56; amino acid residues 75 to 127 of SEQ ID NO: 56; and/or amino acid residues 1 to 74 of SEQ ID NO: 56; and (ii) a penton base polypeptide comprising an amino acid sequence having at least 95% identity to SEQ ID NO: 60. For example, the nucleic acid sequence may encode a hexon polypeptide comprising an amino acid sequence having at least 95% identity to amino acid residues 139 to 452 of SEQ ID NO: 57, wherein the nucleic acid sequence further encodes a fiber polypeptide comprising an amino acid sequence having at least 95% identity to at least one of: amino acid residues 128 to 321 of SEQ ID NO: 56; amino acid residues 75 to 127 of SEQ ID NO: 56; and/or amino acid residues 1 to 74 of SEQ ID NO: 56; and optionally also a penton base polypeptide comprising an amino acid sequence having at least 95% identity to SEQ ID NO: 60. For example, the nucleic acid sequence may encode a hexon polypeptide comprising amino acid residues 139 to 452 of SEQ ID NO: 57, wherein the nucleic acid sequence further encodes a fiber polypeptide comprising: amino acid residues 128 to 321 of SEQ ID NO: 56; amino acid residues 75 to 127 of SEQ ID NO: 56; and amino acid residues 1 to 74 of SEQ ID NO: 56; and optionally also a penton base polypeptide comprising an amino acid sequence of SEQ ID NO: 60.

In a further example, the nucleic acid sequence encodes a hexon polypeptide of SEQ ID NO: 93 and at least one of: (i) a fiber polypeptide of SEQ ID NO: 92; and (ii) a penton base polypeptide of SEQ ID NO: 96. For example, the nucleic acid sequence may encode a hexon polypeptide of SEQ ID NO: 93, wherein the nucleic acid sequence further encodes a fiber polypeptide of SEQ ID NO: 92 and also a penton base polypeptide of SEQ ID NO: 96.

In one example, the nucleic acid sequence encodes a hexon polypeptide comprising an amino acid sequence having at least 95% identity to amino acid residues 139 to 453 of SEQ ID NO: 93 and at least one of: (i) a fiber polypeptide comprising an amino acid sequence having at least 95% identity to at least one of: amino acid residues 127 to 320 of SEQ ID NO: 92; amino acid residues 74 to 126 of SEQ ID NO: 92; and/or amino acid residues 1 to 73 of SEQ ID NO: 92; and (ii) a penton base polypeptide comprising an amino acid sequence having at least 95% identity to SEQ ID NO: 96. For example, the nucleic acid sequence may encode a hexon polypeptide comprising an amino acid sequence having at least 95% identity to amino acid residues 139 to 453 of SEQ ID NO: 93, wherein the nucleic acid sequence further encodes a fiber polypeptide comprising an amino acid sequence having at least 95% identity to at least one of: amino acid residues 127 to 320 of SEQ ID NO: 92; amino acid residues 74 to 126 of SEQ ID NO: 92; and/or amino acid residues 1 to 73 of SEQ ID NO: 92; and optionally also a penton base polypeptide comprising an amino acid sequence having at least 95% identity to SEQ ID NO: 96. For example, the nucleic acid sequence may encode a hexon polypeptide comprising amino acid residues 139 to 453 of SEQ ID NO: 93, wherein the nucleic acid sequence further encodes a fiber polypeptide comprising: amino acid residues 127 to 320 of SEQ ID NO: 92; amino acid residues 74 to 126 of SEQ ID NO: 92; and amino acid residues 1 to 73 of SEQ ID NO: 92; and optionally also a penton base polypeptide comprising an amino acid sequence of SEQ ID NO: 96.

In a further example, the nucleic acid sequence encodes a hexon polypeptide of SEQ ID NO: 23 and at least one of: (i) a fiber polypeptide of SEQ ID NO: 56; and (ii) a penton base polypeptide of SEQ ID NO: 26. For example, the nucleic acid sequence may encode a hexon polypeptide of SEQ ID NO: 23, wherein the nucleic acid sequence further encodes a fiber polypeptide of SEQ ID NO: 56 and also a penton base polypeptide of SEQ ID NO: 26.

In a further example, the nucleic acid sequence encodes a hexon polypeptide of SEQ ID NO: 23 and at least one of: (i) a fiber polypeptide of SEQ ID NO: 92; and (ii) a penton base polypeptide of SEQ ID NO: 26. For example, the nucleic acid sequence may encode a hexon polypeptide of SEQ ID NO: 23, wherein the nucleic acid sequence further encodes a fiber polypeptide of SEQ ID NO: 92 and also a penton base polypeptide of SEQ ID NO: 26.

In a further example, the nucleic acid sequence encodes a hexon polypeptide of SEQ ID NO: 23 and at least one of: (i) a fiber polypeptide of SEQ ID NO: 22; and (ii) a penton base polypeptide of SEQ ID NO: 60. For example, the nucleic acid sequence may encode a hexon polypeptide of SEQ ID NO: 23, wherein the nucleic acid sequence further encodes a fiber polypeptide of SEQ ID NO: 22 and also a penton base polypeptide of SEQ ID NO: 60.

In a further example, the nucleic acid sequence encodes a hexon polypeptide of SEQ ID NO: 23, and at least one of: (i) a fiber polypeptide of SEQ ID NO: 22; and (ii) a penton base polypeptide of SEQ ID NO: 96. For example, the nucleic acid sequence may encode a hexon polypeptide of SEQ ID NO: 23, wherein the nucleic acid sequence further encodes a fiber polypeptide of SEQ ID NO: 22, and also a penton base polypeptide of SEQ ID NO: 96.

In a further example, the nucleic acid sequence encodes a hexon polypeptide of SEQ ID NO: 23 and at least one of: (i) a fiber polypeptide of 56; and (ii) a penton base polypeptide of SEQ ID NO: 60. For example, the nucleic acid sequence may encode a hexon polypeptide of SEQ ID NO: 23, wherein the nucleic acid sequence further encodes a fiber polypeptide of SEQ ID NO: 56 and also a penton base polypeptide of SEQ ID NO: 60.

In a further example, the nucleic acid sequence encodes a hexon polypeptide of SEQ ID NO: 23 and at least one of: (i) a fiber polypeptide of SEQ ID NO: 92; and (ii) a penton base polypeptide of SEQ ID NO: 96. For example, the nucleic acid sequence may encode a hexon polypeptide of SEQ ID NO: 23, wherein the nucleic acid sequence further encodes a fiber polypeptide of SEQ ID NO: 92 and also a penton base polypeptide of SEQ ID NO: 96.

In a further example, the nucleic acid sequence encodes a hexon polypeptide of SEQ ID NO: 23 and at least one of: (i) a fiber polypeptide of SEQ ID NO:56; and (ii) a penton base polypeptide of SEQ ID NO: 96. For example, the nucleic acid sequence may encode a hexon polypeptide of SEQ ID NO: 23, wherein the nucleic acid sequence further encodes a fiber polypeptide of SEQ ID NO: 56 and also a penton base polypeptide of SEQ ID NO: 96.

In another example, the nucleic acid sequence encodes a hexon polypeptide of SEQ ID NO: 23 and at least one of: (i) a fiber polypeptide of SEQ ID NO: 92; and (ii) a penton base polypeptide of SEQ ID NO: 60. For example, the nucleic acid sequence may encode a hexon polypeptide of SEQ ID NO: 23, wherein the nucleic acid sequence further encodes a fiber polypeptide of SEQ ID NO: 92 and also a penton base polypeptide of SEQ ID NO: 60.

In another example, the nucleic acid sequence encodes a hexon polypeptide of SEQ ID NO: 57 and at least one of: (i) a fiber polypeptide of SEQ ID NO: 56; and (ii) a penton base polypeptide of SEQ ID NO: 26. For example, the nucleic acid sequence encoding a hexon polypeptide of SEQ ID NO: 57, wherein the nucleic acid sequence further encodes a fiber polypeptide of SEQ ID NO: 56 and also a penton base polypeptide of SEQ ID NO: 26.

In another example, the nucleic acid sequence encodes a hexon polypeptide of SEQ ID NO: 57 and at least one of: (i) a fiber polypeptide of SEQ ID NO: 92; and (ii) a penton base polypeptide of SEQ ID NO: 26. For example, the nucleic acid sequence may encode a hexon polypeptide of SEQ ID NO: 57, wherein the nucleic acid sequence further encodes a fiber polypeptide of SEQ ID NO: 92 and also a penton base polypeptide of SEQ ID NO: 26.

In another example, the nucleic acid sequence encodes a hexon polypeptide of SEQ ID NO: 57 and at least one of: (i) a fiber polypeptide of SEQ ID NO: 22; and (ii) a penton base polypeptide of SEQ ID NO: 60. For example, the nucleic acid sequence may encode a hexon polypeptide of SEQ ID NO: 57, wherein the nucleic acid sequence further encodes a fiber polypeptide of SEQ ID NO: 22 and also a penton base polypeptide of SEQ ID NO: 60.

In another example, the nucleic acid sequence encodes a hexon polypeptide of SEQ ID NO: 57, and at least one of: (i) a fiber polypeptide of SEQ ID NO: 22; and (ii) a penton base polypeptide of SEQ ID NO: 96. For example, the nucleic acid sequence may encode a hexon polypeptide of SEQ ID NO: 57, wherein the nucleic acid sequence further encodes a fiber polypeptide of SEQ ID NO: 22, and also a penton base polypeptide of SEQ ID NO: 96.

In another example, the nucleic acid sequence encodes a hexon polypeptide of SEQ ID NO: 57 and at least one of: (i) a fiber polypeptide of 56; and (ii) a penton base polypeptide of SEQ ID NO: 60. For example, the nucleic acid sequence may encode a hexon polypeptide of SEQ ID NO: 57, wherein the nucleic acid sequence further encodes a fiber polypeptide of SEQ ID NO: 56 and also a penton base polypeptide of SEQ ID NO: 60.

In another example, the nucleic acid sequence encodes a hexon polypeptide of SEQ ID NO: 57 and at least one of: (i) a fiber polypeptide of SEQ ID NO: 92; and (ii) a penton base polypeptide of SEQ ID NO: 96. For example, the nucleic acid sequence may encode a hexon polypeptide of SEQ ID NO: 57, wherein the nucleic acid sequence further encodes a fiber polypeptide of SEQ ID NO: 92 and also a penton base polypeptide of SEQ ID NO: 96.

In another example, the nucleic acid sequence encodes a hexon polypeptide of SEQ ID NO: 57 and at least one of: (i) a fiber polypeptide of SEQ ID NO:56; and (ii) a penton base polypeptide of SEQ ID NO: 96. For example, the nucleic acid sequence may encode a hexon polypeptide of SEQ ID NO: 57, wherein the nucleic acid sequence further encodes a fiber polypeptide of SEQ ID NO: 56 and also a penton base polypeptide of SEQ ID NO: 96.

In another example, the nucleic acid sequence encodes a hexon polypeptide of SEQ ID NO: 57 and at least one of: (i) a fiber polypeptide of SEQ ID NO: 92; and (ii) a penton base polypeptide of SEQ ID NO: 60. For example, the nucleic acid sequence may encode a hexon polypeptide of SEQ ID NO: 57, wherein the nucleic acid sequence further encodes a fiber polypeptide of SEQ ID NO: 92 and also a penton base polypeptide of SEQ ID NO: 60.

In another example, the nucleic acid sequence encodes a hexon polypeptide of SEQ ID NO: 93 and at least one of: (i) a fiber polypeptide of SEQ ID NO: 56; and (ii) a penton base polypeptide of SEQ ID NO: 26. For example, the nucleic acid sequence may encode a hexon polypeptide of SEQ ID NO: 93, wherein the nucleic acid sequence further encodes a fiber polypeptide of SEQ ID NO: 56 and also a penton base polypeptide of SEQ ID NO: 26.

In another example, the nucleic acid sequence encodes a hexon polypeptide of SEQ ID NO: 93 and at least one of: (i) a fiber polypeptide of SEQ ID NO: 92; and (ii) a penton base polypeptide of SEQ ID NO: 26. For example, the nucleic acid sequence may encode a hexon polypeptide of SEQ ID NO: 93, wherein the nucleic acid sequence further encodes a fiber polypeptide of SEQ ID NO: 92 and also a penton base polypeptide of SEQ ID NO: 26.

In another example, the nucleic acid sequence encodes a hexon polypeptide of SEQ ID NO: 93 and at least one of: (i) a fiber polypeptide of SEQ ID NO: 22; and (ii) a penton base polypeptide of SEQ ID NO: 60. For example, the nucleic acid sequence may encode a hexon polypeptide of SEQ ID NO: 93, wherein the nucleic acid sequence further encodes a fiber polypeptide of SEQ ID NO: 22 and also a penton base polypeptide of SEQ ID NO: 60.

In another example, the nucleic acid sequence encodes a hexon polypeptide of SEQ ID NO: 93, and at least one of: (i) a fiber polypeptide of SEQ ID NO: 22; and (ii) a penton base polypeptide of SEQ ID NO: 96. For example, the nucleic acid sequence may encode a hexon polypeptide of SEQ ID NO: 93, wherein the nucleic acid sequence further encodes a fiber polypeptide of SEQ ID NO: 22, and also a penton base polypeptide of SEQ ID NO: 96.

In another example, the nucleic acid sequence encodes a hexon polypeptide of SEQ ID NO: 93 and at least one of: (i) a fiber polypeptide of 56; and (ii) a penton base polypeptide of SEQ ID NO: 60. For example, the nucleic acid sequence may encode a hexon polypeptide of SEQ ID NO: 93, wherein the nucleic acid sequence further encodes a fiber polypeptide of SEQ ID NO: 56 and also a penton base polypeptide of SEQ ID NO: 60.

In another example, the nucleic acid sequence encodes a hexon polypeptide of SEQ ID NO: 93 and at least one of: (i) a fiber polypeptide of SEQ ID NO: 92; and (ii) a penton base polypeptide of SEQ ID NO: 96. For example, the nucleic acid sequence may encode a hexon polypeptide of SEQ ID NO: 93, wherein the nucleic acid sequence further encodes a fiber polypeptide of SEQ ID NO: 92 and also a penton base polypeptide of SEQ ID NO: 96.

In another example, the nucleic acid sequence encodes a hexon polypeptide of SEQ ID NO: 93 and at least one of: (i) a fiber polypeptide of SEQ ID NO:56; and (ii) a penton base polypeptide of SEQ ID NO: 96. For example, the nucleic acid sequence may encode a hexon polypeptide of SEQ ID NO: 93, wherein the nucleic acid sequence further encodes a fiber polypeptide of SEQ ID NO: 56 and also a penton base polypeptide of SEQ ID NO: 96.

In another example, the nucleic acid sequence encodes a hexon polypeptide of SEQ ID NO: 93 and at least one of: (i) a fiber polypeptide of SEQ ID NO: 92; and (ii) a penton base polypeptide of SEQ ID NO: 60. For example, the nucleic acid sequence may encode a hexon polypeptide of SEQ ID NO: 93, wherein the nucleic acid sequence further encodes a fiber polypeptide of SEQ ID NO: 92 and also a penton base polypeptide of SEQ ID NO: 60.

An isolated non-human primate adenovirus nucleic acid sequence is also provided herein, wherein the sequence comprises or consists of a nucleic acid sequence of SEQ ID NO: 1 and its complement.

Furthermore, an alternative isolated non-human primate adenovirus nucleic acid sequence is also provided herein, wherein the sequence comprises or consists of a nucleic acid sequence of SEQ ID NO: 36 and its complement.

Also provided is an isolated non-human primate adenovirus nucleic acid sequence, wherein the sequence comprises or consists of a nucleic acid sequence of SEQ ID NO: 71 and its complement.

Nucleic acid sequences are provided above that encode one or more polypeptides. Vectors that comprise these nucleic acid sequences are also provided. The vector may be an adenoviral vector. Preferably, the viral vector is an oncolytic adenoviral vector.

Polypeptides encoded by the described nucleic acid sequences are equally provided herein.

Subgroup B(-Like) Adenoviruses

Novel NHP adenoviruses that identify with human subgroup B adenoviruses are also described herein. The novel adenoviruses are defined by at least one novel capsid protein e.g. hexon, penton base and/or fiber (or fragments thereof e.g. HVR, tail, knob or shaft domains). The novel capsid proteins have already been described in detail in the context of nucleic acid sequences that encode them (above). The corresponding NHP adenoviruses are described in detail below.

Hexon Sequences

Isolated NHP adenoviruses are provided herein having a capsid comprising at least one capsid polypeptide, e.g. a hexon polypeptide.

The hexon polypeptide may comprise an amino acid sequence having at least 95% sequence identity to: amino acid residues 139 to 455 of SEQ ID NO: 23; amino acid residues 139 to 452 of SEQ ID NO: 57; or amino acid residues 139 to 453 of SEQ ID NO: 93. These regions of the hexon represent the hypervariable regions of the novel hexons provided herein (i.e. for NHP 007, NHP 012 and NHP 006 respectively).

The hexon polypeptide may comprise an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 455 of SEQ ID NO: 23. Amino acid residues 139 to 455 of SEQ ID NO: 23 correspond to the HVR of novel adenovirus NHP 007 described herein.

For example, the hexon polypeptide may comprise an amino acid sequence having at least 98.5%, at least 99% or 100% identity to SEQ ID NO: 23. In other words, the hexon polypeptide may comprise an amino acid sequence that is identical to SEQ ID NO: 23.

Alternatively, the hexon polypeptide may comprise an amino acid sequence having at least 81%, at least 85%, at least 90%, at least 91%, at least 92%, at least 93%, at least 94%, at least 95%, at least 96%, at least 97%, at least 98%, at least 99% or 100% identity to amino acid residues 139 to 452 of SEQ ID NO: 57. Amino acid residues 139 to 452 of SEQ ID NO: 57 correspond to the HVR of novel adenovirus NHP 012 described herein.

In this example, the polypeptide may comprise an amino acid sequence having at least 95%, at least 99.5% or 100% identity to SEQ ID NO: 57. In other words, the hexon polypeptide may comprise an amino acid sequence that is identical to SEQ ID NO: 57.

In an alternative example, the hexon polypeptide may comprise an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 453 of SEQ ID NO: 93. Amino acid residues 139 to 453 of SEQ ID NO: 93 correspond to the HVR of novel adenovirus NHP 006 described herein.

In this example, the hexon polypeptide may comprise an amino acid sequence having at least 88.5%, at least 89%, at least 90%, at least 91%, at least 92%, at least 93%, at least 94%, 95%, at least 96%, at least 97%, at least 98% at least 99% or 100% identity to SEQ ID NO: 93. In other words, the hexon polypeptide may comprise an amino acid sequence that is identical to SEQ ID NO: 93.

Fiber Sequences

Isolated NHP adenoviruses are also provided herein having a capsid comprising at least one capsid polypeptide, e.g. a fiber polypeptide.

The fiber polypeptide may comprise an amino acid sequence having at least 95% sequence identity to at least one of: amino acid residues 128 to 322 of SEQ ID NO: 22; amino acid residues 75 to 127 of SEQ ID NO: 22; amino acid residues 1 to 74 of SEQ ID NO: 22; amino acid residues 128 to 321 of SEQ ID NO: 56; amino acid residues 75 to 127 of SEQ ID NO: 56; amino acid residues 1 to 74 of SEQ ID NO: 56; amino acid residues 127 to 320 of SEQ ID NO: 92; amino acid residues 74 to 126 of SEQ ID NO: 92; or amino acid residues 1 to 73 of SEQ ID NO: 92. The defined amino acid regions for SEQ ID NO: 22 represent the "knob", "shaft" and "tail" domains respectively of the fiber protein for new adenovirus NHP 007 described herein; the defined amino acid regions for SEQ ID NO: 56 represent the "knob", "shaft" and "tail" domains respectively of the fiber protein for new adenovirus NHP 012 described herein; and similarly, the defined amino acid regions for SEQ ID NO: 92 represent the "knob", "shaft" and "tail" domains respectively of the fiber protein for new adenovirus NHP 006 described herein.

The fiber polypeptide may comprise an amino acid sequence having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, two, or three of: amino acid residues 128 to 322 of SEQ ID NO: 22; amino acid residues 75 to 127 of SEQ ID NO: 22; amino acid residues 1 to 74 of SEQ ID NO: 22. For example, the polypeptide may have at least 69% identity to residues 128 to 322 of SEQ ID NO: 22. Alternatively, the polypeptide may have at least 60% identity to residues 75 to 127 of SEQ ID NO: 22. Alternatively, the polypeptide may have at least 84% identity to residues 1 to 74 of SEQ ID NO: 22. For example, the fiber polypeptide may comprise an amino acid sequence having at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 22.

Alternatively, the fiber polypeptide may comprise an amino acid sequence having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 128 to 321 of SEQ ID NO: 56; amino acid residues 75 to 127 of SEQ ID NO: 56; amino acid residues 1 to 74 of SEQ ID NO: 56. For example, the polypeptide may have at least 60% identity to residues 128 to 321 of SEQ ID NO: 56. Alternatively, the polypeptide may have at least 61% identity to residues 75 to 127 of SEQ ID NO: 56. Alternatively, the polypeptide may have at least 86% identity to residues 1 to 74 of SEQ ID NO: 56. For example, the fiber polypeptide may comprise an amino acid sequence having at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 56.

In another example, the fiber polypeptide may comprise an amino acid sequence having at least 63%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 127 to 320 of SEQ ID NO: 92; amino acid residues 74 to 126 of SEQ ID NO: 92; or amino acid residues 1 to 73 of SEQ ID NO: 92. Alternatively, the polypeptide may have at least 68% identity to residues 127 to 320 of SEQ ID NO: 92. Alternatively, the polypeptide may have at least 63% identity to residues 74 to 126 of SEQ ID NO: 92. Alternatively, the polypeptide may have at least 86% identity to residues 1 to 73 of SEQ ID NO: 92. For example, the fiber polypeptide may comprise an amino acid sequence having at least 71%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 92.

Penton Base

Isolated NHP adenoviruses are also provided herein having a capsid comprising at least one capsid polypeptide, e.g. a penton base polypeptide.

The penton base polypeptide may comprise an amino acid sequence having at least 93%, at least 94%, at least 95%, at least 96%, at least 97%, at least 98%, at least 99% or 100% identity to SEQ ID NO: 26. In other words, the penton base polypeptide may comprise an amino acid sequence that is identical to SEQ ID NO: 26.

Alternatively, the penton base polypeptide may comprise an amino acid sequence having at least 95%, at least 96%, at least 97%, at least 98%, at least 99% or 100% identity to SEQ ID NO: 60. In other words, the penton base polypeptide may comprise an amino acid sequence that is identical to SEQ ID NO: 60.

Alternatively, the penton base polypeptide may comprise an amino acid sequence having at least 93%, at least 94%, at least 95%, at least 96%, at least 97%, at least 98%, at least 99% or 100% identity to SEQ ID NO: 96. In other words, the penton base polypeptide may comprise an amino acid sequence that is identical to SEQ ID NO: 96.

Combinations

Isolated NHP adenoviruses provided herein have a capsid that includes any combination (i.e. at least two, at least three etc) of the individual hexon, penton base and fiber amino acid sequences provided herein.

Accordingly, the NHP adenovirus may have a capsid that comprises a hexon polypeptide as defined herein, and at least one of: (i) a fiber polypeptide as defined herein; and (ii) a penton base polypeptide as defined herein. In one example, the NHP adenovirus may have a capsid that comprises a hexon polypeptide as defined herein, and further comprises a fiber polypeptide as defined herein and also a penton base polypeptide as defined herein.

In one example, the NHP adenovirus may have a capsid that comprises a hexon polypeptide of SEQ ID NO: 23, SEQ ID NO: 57, or SEQ ID NO: 93 and at least one of: (i) a fiber polypeptide of SEQ ID NO: 22, 56 or 92; and (ii) a penton base polypeptide of SEQ ID NO: 26, 60 or 96. The NHP adenovirus may have a capsid that comprises a hexon polypeptide of SEQ ID NO: 23, SEQ ID NO: 57, or SEQ ID NO: 93, wherein the capsid further comprises a fiber polypeptide of SEQ ID NO: 22, 56 or 92 and also a penton base polypeptide of SEQ ID NO: 26, 60 or 96.

In one example, the NHP adenovirus has a capsid that comprises a hexon polypeptide of SEQ ID NO: 23 and at least one of: (i) a fiber polypeptide of SEQ ID NO: 22; and (ii) a penton base polypeptide of SEQ ID NO: 26. For example, the NHP adenovirus may have a capsid that comprises a hexon polypeptide of SEQ ID NO: 23, wherein the capsid further comprises a fiber polypeptide of SEQ ID NO: 22 and also a penton base polypeptide of SEQ ID NO: 26.

In one example the NHP adenovirus has a capsid that comprises a hexon polypeptide comprising an amino acid sequence having at least 95% identity to amino acid residues 139 to 455 of SEQ ID NO: 23 and at least one of: (i) a fiber polypeptide comprising an amino acid sequence having at least 95% identity to at least one of: amino acid residues 128 to 322 of SEQ ID NO: 22; amino acid residues 75 to 127 of SEQ ID NO: 22 and/or amino acid residues 1 to 74 of SEQ ID NO: 22; and (ii) a penton base polypeptide comprising an amino acid sequence having at least 95% identity to SEQ ID NO: 26. For example, the NHP adenovirus may have a capsid that comprises hexon polypeptide comprising an amino acid sequence having at least 95% identity to amino acid residues 139 to 455 of SEQ ID NO: 23, wherein the capsid further comprises a fiber polypeptide comprising an amino acid sequence having at least 95% identity to at least one of: amino acid residues 128 to 322 of SEQ ID NO: 22; amino acid residues 75 to 127 of SEQ ID NO: 22; and/or amino acid residues 1 to 74 of SEQ ID NO: 22; and optionally also a penton base polypeptide comprising an amino acid sequence having at least 95% identity to SEQ ID NO: 26. In one example, the NHP adenovirus may have a capsid that comprises hexon polypeptide comprising amino acid residues 139 to 455 of SEQ ID NO: 23, wherein the capsid further comprises a fiber polypeptide comprising amino acid residues 128 to 322 of SEQ ID NO: 22; amino acid residues 75 to 127 of SEQ ID NO: 22; and amino acid residues 1 to 74 of SEQ ID NO: 22; and optionally also a penton base polypeptide comprising an amino acid sequence of SEQ ID NO: 26.

In another example, the NHP adenovirus has a capsid that comprises a hexon polypeptide of SEQ ID NO: 57 and at least one of: (i) a fiber polypeptide of SEQ ID NO: 56; and (ii) a penton base polypeptide of SEQ ID NO: 60. For example, the NHP adenovirus may have a capsid that comprises a hexon polypeptide of SEQ ID NO: 57, wherein the capsid further comprises a fiber polypeptide of SEQ ID NO: 56 and also a penton base polypeptide of SEQ ID NO: 60.

In one example, the NHP adenovirus has a capsid that comprises a hexon polypeptide comprising an amino acid sequence having at least 95% identity to amino acid residues 139 to 452 of SEQ ID NO: 57 and at least one of: (i) a fiber polypeptide comprising an amino acid sequence having at least 95% identity to at least one of: amino acid residues 128 to 321 of SEQ ID NO: 56; amino acid residues 75 to 127 of SEQ ID NO: 56; and/or amino acid residues 1 to 74 of SEQ ID NO: 56; and (ii) a penton base polypeptide comprising an amino acid sequence having at least 95% identity to SEQ ID NO: 60. For example, the NHP adenovirus may have a capsid that comprises a hexon polypeptide comprising an amino acid sequence having at least 95% identity to amino acid residues 139 to 452 of SEQ ID NO: 57, wherein the capsid further comprises a fiber polypeptide comprising an amino acid sequence having at least 95% identity to at least one of: amino acid residues 128 to 321 of SEQ ID NO: 56; amino acid residues 75 to 127 of SEQ ID NO: 56; and/or amino acid residues 1 to 74 of SEQ ID NO: 56; and optionally also a penton base polypeptide comprising an amino acid sequence having at least 95% identity to SEQ ID NO: 60. For example, the NHP adenovirus may have a capsid that comprises a hexon polypeptide comprising amino acid residues 139 to 452 of SEQ ID NO: 57, wherein the capsid further comprises a fiber polypeptide comprising amino acid residues 128 to 321 of SEQ ID NO: 56; amino acid residues 75 to 127 of SEQ ID NO: 56; and amino acid residues 1 to 74 of SEQ ID NO: 56; and optionally also a penton base polypeptide comprising an amino acid sequence of SEQ ID NO: 60.

In a further example, the NHP adenovirus has a capsid that comprises a hexon polypeptide of SEQ ID NO: 93 and at least one of: (i) a fiber polypeptide of SEQ ID NO: 92; and (ii) a penton base polypeptide of SEQ ID NO: 96. For example, the NHP adenovirus may have a capsid that comprises a hexon polypeptide of SEQ ID NO: 93, wherein the capsid further comprises a fiber polypeptide of SEQ ID NO: 92 and also a penton base polypeptide of SEQ ID NO: 96.

In one example, the NHP adenovirus may have a capsid that comprises a hexon polypeptide comprising an amino acid sequence having at least 95% identity to amino acid residues 139 to 453 of SEQ ID NO: 93 and at least one of: (i) a fiber polypeptide comprising an amino acid sequence having at least 95% identity to at least one of: amino acid residues 127 to 320 of SEQ ID NO: 92; amino acid residues 74 to 126 of SEQ ID NO: 92; and/or amino acid residues 1 to 73 of SEQ ID NO: 92; and (ii) a penton base polypeptide comprising an amino acid sequence having at least 95% identity to SEQ ID NO: 96. For example, the NHP adenovirus may have a capsid that comprises a hexon polypeptide comprising an amino acid sequence having at least 95% identity to amino acid residues 139 to 453 of SEQ ID NO: 93, wherein the capsid further comprises a fiber polypeptide comprising an amino acid sequence having at least 95% identity to at least one of: amino acid residues 127 to 320 of SEQ ID NO: 92; amino acid residues 74 to 126 of SEQ ID NO: 92; and/or amino acid residues 1 to 73 of SEQ ID NO: 92; and optionally also a penton base polypeptide comprising an amino acid sequence having at least 95% identity to SEQ ID NO: 96. For example, the NHP adenovirus may have a capsid that comprises a hexon polypeptide comprising amino acid residues 139 to 453 of SEQ ID NO: 93, wherein the capsid further comprises a fiber polypeptide comprising: amino acid residues 127 to 320 of SEQ ID NO: 92; amino acid residues 74 to 126 of SEQ ID NO: 92; and amino acid residues 1 to 73 of SEQ ID NO: 92; and optionally also a penton base polypeptide comprising an amino acid sequence of SEQ ID NO: 96.

In a further example, the NHP adenovirus has a capsid that comprises a hexon polypeptide of SEQ ID NO: 23 and at least one of: (i) a fiber polypeptide of SEQ ID NO: 56; and (ii) a penton base polypeptide of SEQ ID NO: 26. For example, the NHP adenovirus may have a capsid that comprises a hexon polypeptide of SEQ ID NO: 23, wherein the capsid further comprises a fiber polypeptide of SEQ ID NO: 56 and also a penton base polypeptide of SEQ ID NO: 26. In a further example, the NHP adenovirus has a capsid that comprises a hexon polypeptide of SEQ ID NO: 23 and at least one of: (i) a fiber polypeptide of SEQ ID NO: 92; and (ii) a penton base polypeptide of SEQ ID NO: 26. For example, the NHP adenovirus may have a capsid that comprises a hexon polypeptide of SEQ ID NO: 23, wherein the capsid further comprises a fiber polypeptide of SEQ ID NO: 92 and also a penton base polypeptide of SEQ ID NO: 26.

In a further example, the NHP adenovirus has a capsid that comprises a hexon polypeptide of SEQ ID NO: 23 and at least one of: (i) a fiber polypeptide of SEQ ID NO: 22; and (ii) a penton base polypeptide of SEQ ID NO: 60. For example, the NHP adenovirus may have a capsid that comprises hexon polypeptide of SEQ ID NO: 23, wherein the capsid further comprises a fiber polypeptide of SEQ ID NO: 22 and also a penton base polypeptide of SEQ ID NO: 60.

In a further example, the NHP adenovirus has a capsid that comprises a hexon polypeptide of SEQ ID NO: 23, and at least one of: (i) a fiber polypeptide of SEQ ID NO: 22; and (ii) a penton base polypeptide of SEQ ID NO: 96. For example, the NHP adenovirus may have a capsid that comprises a hexon polypeptide of SEQ ID NO: 23, wherein the capsid further comprises a fiber polypeptide of SEQ ID NO: 22, and also a penton base polypeptide of SEQ ID NO: 96.

In a further example, the NHP adenovirus has a capsid that comprises a hexon polypeptide of SEQ ID NO: 23 and at least one of: (i) a fiber polypeptide of 56; and (ii) a penton base polypeptide of SEQ ID NO: 60. For example, the NHP adenovirus may have a capsid that comprises a hexon polypeptide of SEQ ID NO: 23, wherein the capsid further comprises a fiber polypeptide of SEQ ID NO: 56 and also a penton base polypeptide of SEQ ID NO: 60.

In a further example, the NHP adenovirus has a capsid that comprises a hexon polypeptide of SEQ ID NO: 23 and at least one of: (i) a fiber polypeptide of SEQ ID NO: 92; and (ii) a penton base polypeptide of SEQ ID NO: 96. For example, the NHP adenovirus may have a capsid that comprises a hexon polypeptide of SEQ ID NO: 23, wherein the capsid further comprises a fiber polypeptide of SEQ ID NO: 92 and also a penton base polypeptide of SEQ ID NO: 96.

In a further example, the NHP adenovirus has a capsid that comprises a hexon polypeptide of SEQ ID NO: 23 and at least one of: (i) a fiber polypeptide of SEQ ID NO:56; and (ii) a penton base polypeptide of SEQ ID NO: 96. For example, the NHP adenovirus may have a capsid that comprises a hexon polypeptide of SEQ ID NO: 23, wherein the capsid further comprises a fiber polypeptide of SEQ ID NO: 56 and also a penton base polypeptide of SEQ ID NO: 96.

In another example, the NHP adenovirus has a capsid that comprises a hexon polypeptide of SEQ ID NO: 23 and at least one of: (i) a fiber polypeptide of SEQ ID NO: 92; and (ii) a penton base polypeptide of SEQ ID NO: 60. For example, the NHP adenovirus may have a capsid that comprises a hexon polypeptide of SEQ ID NO: 23, wherein the capsid further comprises a fiber polypeptide of SEQ ID NO: 92 and also a penton base polypeptide of SEQ ID NO: 60.

In another example, the NHP adenovirus has a capsid that comprises a hexon polypeptide of SEQ ID NO: 57 and at least one of: (i) a fiber polypeptide of SEQ ID NO: 56; and (ii) a penton base polypeptide of SEQ ID NO: 26. For example, the NHP adenovirus may have a capsid that comprises a hexon polypeptide of SEQ ID NO: 57, wherein the capsid further comprises a fiber polypeptide of SEQ ID NO: 56 and also a penton base polypeptide of SEQ ID NO: 26.

In another example, the NHP adenovirus has a capsid that comprises a hexon polypeptide of SEQ ID NO: 57 and at least one of: (i) a fiber polypeptide of SEQ ID NO: 92; and (ii) a penton base polypeptide of SEQ ID NO: 26. For example, the NHP adenovirus may have a capsid that comprises a hexon polypeptide of SEQ ID NO: 57, wherein the capsid further comprises a fiber polypeptide of SEQ ID NO: 92 and also a penton base polypeptide of SEQ ID NO: 26.

In another example, the NHP adenovirus has a capsid that comprises a hexon polypeptide of SEQ ID NO: 57 and at least one of: (i) a fiber polypeptide of SEQ ID NO: 22; and (ii) a penton base polypeptide of SEQ ID NO: 60. For example, the NHP adenovirus may have a capsid that comprises a hexon polypeptide of SEQ ID NO: 57, wherein the capsid further comprises a fiber polypeptide of SEQ ID NO: 22 and also a penton base polypeptide of SEQ ID NO: 60.

In another example, the NHP adenovirus has a capsid that comprises a hexon polypeptide of SEQ ID NO: 57, and at least one of: (i) a fiber polypeptide of SEQ ID NO: 22; and (ii) a penton base polypeptide of SEQ ID NO: 96. For example, the NHP adenovirus may have a capsid that comprises a hexon polypeptide of SEQ ID NO: 57, wherein the capsid further comprises a fiber polypeptide of SEQ ID NO: 22, and also a penton base polypeptide of SEQ ID NO: 96.

In another example, the NHP adenovirus has a capsid that comprises a hexon polypeptide of SEQ ID NO: 57 and at least one of: (i) a fiber polypeptide of 56; and (ii) a penton base polypeptide of SEQ ID NO: 60. For example, the NHP adenovirus may have a capsid that comprises a hexon polypeptide of SEQ ID NO: 57, wherein the capsid further comprises a fiber polypeptide of SEQ ID NO: 56 and also a penton base polypeptide of SEQ ID NO: 60.

In another example, the NHP adenovirus has a capsid that comprises a hexon polypeptide of SEQ ID NO: 57 and at least one of: (i) a fiber polypeptide of SEQ ID NO: 92; and (ii) a penton base polypeptide of SEQ ID NO: 96. For example, the NHP adenovirus may have a capsid that comprises a hexon polypeptide of SEQ ID NO: 57, wherein the capsid further comprises a fiber polypeptide of SEQ ID NO: 92 and also a penton base polypeptide of SEQ ID NO: 96.

In another example, the NHP adenovirus has a capsid that comprises a hexon polypeptide of SEQ ID NO: 57 and at least one of: (i) a fiber polypeptide of SEQ ID NO:56; and (ii) a penton base polypeptide of SEQ ID NO: 96. For example, the NHP adenovirus may have a capsid that comprises a hexon polypeptide of SEQ ID NO: 57, wherein the capsid further comprises a fiber polypeptide of SEQ ID NO: 56 and also a penton base polypeptide of SEQ ID NO: 96.

In another example, the NHP adenovirus has a capsid that comprises a hexon polypeptide of SEQ ID NO: 57 and at least one of: (i) a fiber polypeptide of SEQ ID NO: 92; and (ii) a penton base polypeptide of SEQ ID NO: 60. For example, the NHP adenovirus may have a capsid that comprises a hexon polypeptide of SEQ ID NO: 57, wherein the capsid further comprises a fiber polypeptide of SEQ ID NO: 92 and also a penton base polypeptide of SEQ ID NO: 60.

In another example, the NHP adenovirus has a capsid that comprises a hexon polypeptide of SEQ ID NO: 93 and at least one of: (i) a fiber polypeptide of SEQ ID NO: 56; and (ii) a penton base polypeptide of SEQ ID NO: 26. For example, the NHP adenovirus may have a capsid that comprises a hexon polypeptide of SEQ ID NO: 93, wherein the capsid further comprises a fiber polypeptide of SEQ ID NO: 56 and also a penton base polypeptide of SEQ ID NO: 26.

In another example, the NHP adenovirus has a capsid that comprises a hexon polypeptide of SEQ ID NO: 93 and at least one of: (i) a fiber polypeptide of SEQ ID NO: 92; and (ii) a penton base polypeptide of SEQ ID NO: 26. For example, the NHP adenovirus may have a capsid that comprises a hexon polypeptide of SEQ ID NO: 93, wherein the capsid further comprises a fiber polypeptide of SEQ ID NO: 92 and also a penton base polypeptide of SEQ ID NO: 26.

In another example, the NHP adenovirus has a capsid that comprises a hexon polypeptide of SEQ ID NO: 93 and at least one of: (i) a fiber polypeptide of SEQ ID NO: 22; and (ii) a penton base polypeptide of SEQ ID NO: 60. For example, the NHP adenovirus may have a capsid that comprises a hexon polypeptide of SEQ ID NO: 93, wherein the capsid further comprises a fiber polypeptide of SEQ ID NO: 22 and also a penton base polypeptide of SEQ ID NO: 60.

In another example, the NHP adenovirus has a capsid that comprises a hexon polypeptide of SEQ ID NO: 93, and at least one of: (i) a fiber polypeptide of SEQ ID NO: 22; and (ii) a penton base polypeptide of SEQ ID NO: 96. For example, the NHP adenovirus may have a capsid that comprises a hexon polypeptide of SEQ ID NO: 93, wherein the capsid further comprises a fiber polypeptide of SEQ ID NO: 22, and also a penton base polypeptide of SEQ ID NO: 96.

In another example, the NHP adenovirus has a capsid that comprises a hexon polypeptide of SEQ ID NO: 93 and at least one of: (i) a fiber polypeptide of 56; and (ii) a penton base polypeptide of SEQ ID NO: 60. For example, the NHP adenovirus may have a capsid that comprises a hexon polypeptide of SEQ ID NO: 93, wherein the capsid further comprises a fiber polypeptide of SEQ ID NO: 56 and also a penton base polypeptide of SEQ ID NO: 60.

In another example, the NHP adenovirus has a capsid that comprises a hexon polypeptide of SEQ ID NO: 93 and at least one of: (i) a fiber polypeptide of SEQ ID NO: 92; and (ii) a penton base polypeptide of SEQ ID NO: 96. For example, the NHP adenovirus may have a capsid that comprises a hexon polypeptide of SEQ ID NO: 93, wherein the capsid further comprises a fiber polypeptide of SEQ ID NO: 92 and also a penton base polypeptide of SEQ ID NO: 96.

In another example, the NHP adenovirus has a capsid that comprises a hexon polypeptide of SEQ ID NO: 93 and at least one of: (i) a fiber polypeptide of SEQ ID NO:56; and (ii) a penton base polypeptide of SEQ ID NO: 96. For example, the NHP adenovirus may have a capsid that comprises a hexon polypeptide of SEQ ID NO: 93, wherein the capsid further comprises a fiber polypeptide of SEQ ID NO: 56 and also a penton base polypeptide of SEQ ID NO: 96.

In another example, the NHP adenovirus has a capsid that comprises a hexon polypeptide of SEQ ID NO: 93 and at least one of: (i) a fiber polypeptide of SEQ ID NO: 92; and (ii) a penton base polypeptide of SEQ ID NO: 60. For example, the NHP adenovirus may have a capsid that comprises a hexon polypeptide of SEQ ID NO: 93, wherein the capsid further comprises a fiber polypeptide of SEQ ID NO: 92 and also a penton base polypeptide of SEQ ID NO: 60.

Subgroup C(-Like) Nucleic Acid Sequences

Hexon Sequences

Isolated nucleic acid sequences are provided herein that encode a hexon polypeptide comprising an amino acid sequence having at least 95% sequence identity to: amino acid residues 137 to 452 of SEQ ID NO: 129; amino acid residues 137 to 452 of SEQ ID NO: 163; or amino acid residues 139 to 456 of SEQ ID NO: 197. These regions of the hexon represent the hypervariable regions of the novel hexons provided herein (i.e. for NHP 002, NHP 005 and NHP 008 respectively).

The isolated nucleic acid sequence may encode a hexon polypeptide comprising an amino acid sequence having at least 87%, at least 90%, at least 91%, at least 92%, at least 93%, at least 94%, at least 95%, at least 96%, at least 97%, at least 98%, at least 99% or 100% identity to amino acid residues 137 to 452 of SEQ ID NO: 129. Amino acid residues 137 to 452 of SEQ ID NO: 129 correspond to the HVR of novel adenovirus NHP 002 described herein.

For example, the isolated nucleic acid sequence may encode a hexon polypeptide comprising an amino acid sequence having at least 94%, at least 95%, at least 96%, at least 97% at least 98% at least 99% or 100% identity to SEQ ID NO: 129. In other words, the isolated nucleic acid sequence may encode a hexon polypeptide comprising an amino acid sequence that is identical to SEQ ID NO: 129.

Alternatively, the isolated nucleic acid sequence may encode a hexon polypeptide comprising an amino acid sequence having at least 76%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 444 of SEQ ID NO: 163. Amino acid residues 139 to 444 of SEQ ID NO: 163 correspond to the HVR of novel adenovirus NHP 005 described herein.

In this example, the isolated nucleic acid sequence may encode a hexon polypeptide comprising an amino acid sequence having at least 96%, at least 97% at least 98% at least 99% or 100% identity to SEQ ID NO: 163. In other words, the isolated nucleic acid sequence may encode a hexon polypeptide comprising an amino acid sequence that is identical to SEQ ID NO: 163.

In an alternative example, the isolated nucleic acid sequence may encode a hexon polypeptide comprising an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 456 of SEQ ID NO: 197. Amino acid residues 139 to 456 of SEQ ID NO: 197 correspond to the HVR of novel adenovirus NHP 008 described herein.

In this example, the isolated nucleic acid sequence may encode a hexon polypeptide comprising an amino acid sequence having at least 99.5% or 100% identity to SEQ ID NO: 197. In other words, the isolated nucleic acid sequence may encode a hexon polypeptide comprising an amino acid sequence that is identical to SEQ ID NO: 197.

Fiber Sequences

Isolated nucleic acid sequences are also provided herein that encode a fiber polypeptide comprising an amino acid sequence having at least 95% sequence identity to at least one of: amino acid residues 388 to 577 of SEQ ID NO: 128; amino acid residues 76 to 387 of SEQ ID NO: 128; amino acid residues 1 to 75 of SEQ ID NO: 128; amino acid residues 392 to 581 of SEQ ID NO: 162; amino acid residues 76 to 391 of SEQ ID NO: 162; amino acid residues 1 to 75 of SEQ ID NO: 162; amino acid residues 391 to 580 of SEQ ID NO: 196; amino acid residues 76 to 390 of SEQ ID NO: 196; or amino acid residues 1 to 75 of SEQ ID NO: 196. The defined amino acid regions for SEQ ID NO: 128 represent the "knob", "shaft" and "tail" domains respectively of the fiber protein for new adenovirus NHP 002 described herein; the defined amino acid regions for SEQ ID NO: 162 represent the "knob", "shaft" and "tail" domains respectively of the fiber protein for new adenovirus NHP 005 described herein; and similarly, the defined amino acid regions for SEQ ID NO: 196 represent the "knob", "shaft" and "tail" domains respectively of the fiber protein for new adenovirus NHP 008 described herein).

The isolated nucleic acid sequence may encode a fiber polypeptide comprising an amino acid sequence having at least 73%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, two, or three of: amino acid residues 388 to 577 of SEQ ID NO: 128; amino acid residues 76 to 387 of SEQ ID NO: 128; amino acid residues 1 to 75 of SEQ ID NO: 128. For example, the isolated nucleic acid sequence may encode a fiber polypeptide comprising an amino acid sequence having at least 82% identity to residues 388 to 577 of SEQ ID NO: 128. For example, the isolated nucleic acid sequence may encode a fiber polypeptide comprising an amino acid sequence having at least 73% identity to residues 76 to 387 of SEQ ID NO: 128. For example, the isolated nucleic acid sequence may encode a fiber polypeptide comprising an amino acid sequence having at least 89% identity to residues 1 to 75 of SEQ ID NO: 128. For example, the encoded fiber polypeptide may comprise an amino acid sequence having at least 78%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 128.

Alternatively, the isolated nucleic acid sequence may encode a fiber polypeptide comprising an amino acid sequence having at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 392 to 581 of SEQ ID NO: 162; amino acid residues 76 to 391 of SEQ ID NO: 162; amino acid residues 1 to 75 of SEQ ID NO: 162. For example, the isolated nucleic acid sequence may encode a fiber polypeptide comprising an amino acid sequence having at least 66% identity to amino acid residues 392 to 581 of SEQ ID NO: 162. For example, the isolated nucleic acid sequence may encode a fiber polypeptide comprising an amino acid sequence having at least 55% to residues 76 to 391 of SEQ ID NO: 162. For example, the isolated nucleic acid sequence may encode a fiber polypeptide comprising an amino acid sequence having at least 77% identity to residues 1 to 75 of SEQ ID NO: 162. For example, the encoded fiber polypeptide may comprise an amino acid sequence having at least 64%, at least 65%, at least 70%, at least 75%, at least 80%, at least 85%, at least 90%, at least 91%, at least 92%, at least 93%, at least 94%, at least 95%, 95%, at least 96%, at least 97%, at least 98%, at least 99% or 100% identity to SEQ ID NO: 162.

In another example, the isolated nucleic acid sequence may encode a fiber polypeptide comprising an amino acid sequence having at least 56%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 391 to 580 of SEQ ID NO: 196; amino acid residues 76 to 390 of SEQ ID NO: 196; or amino acid residues 1 to 75 of SEQ ID NO: 196. For example, the isolated nucleic acid sequence may encode a fiber polypeptide comprising an amino acid sequence having at least 69% identity to residues 391 to 580 of SEQ ID NO: 196. For example, the isolated nucleic acid sequence may encode a fiber polypeptide comprising an amino acid sequence having at least 56% identity to residues 76 to 390 of SEQ ID NO: 196. For example, the isolated nucleic acid sequence may encode a fiber polypeptide comprising at least 73% identity to residues 1 to 75 of SEQ ID NO: 196. For example, the encoded fiber polypeptide may comprise an amino acid sequence having at least 62%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 196.

Penton Base

An isolated nucleic acid sequence encoding a penton base polypeptide is also provided, comprising an amino acid sequence having at least 85%, at least 90%, at least 91%, at least 92%, at least 93%, at least 94%, at least 95%, at least 96%, at least 97%, at least 98%, at least 99% or 100% identity to SEQ ID NO: 132. In other words, the isolated nucleic acid sequence may encode penton base polypeptide comprising an amino acid sequence that is identical to SEQ ID NO: 132.

Alternatively, an isolated nucleic acid sequence encoding a penton base polypeptide is also provided, comprising an amino acid sequence having at least 72%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 166. In other words, the isolated nucleic acid sequence may encode penton base polypeptide comprising an amino acid sequence that is identical to SEQ ID NO: 166.

Alternatively, an isolated nucleic acid sequence encoding a penton base polypeptide is also provided, comprising an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 200. In other words, the isolated nucleic acid sequence may encode penton base polypeptide comprising an amino acid sequence that is identical to SEQ ID NO: 200.

Combinations

An isolated nucleic acid sequence provided herein may include any combination (i.e. at least two, at least three etc) of the individual hexon, penton base and fiber sequences (or fragments thereof e.g. HVR, shaft, tail or knob domains) provided herein.

Accordingly, a nucleic acid sequence is provided that encodes a hexon polypeptide as defined herein, and at least one of: (i) a fiber polypeptide as defined herein; and (ii) a penton base polypeptide as defined herein. In one example, the nucleic acid sequence encodes a hexon polypeptide as defined herein, and further encodes a fiber polypeptide as defined herein and also a penton base polypeptide as defined herein.

In one example, a nucleic acid sequence provided herein may encode a hexon polypeptide of SEQ ID NO: 129, SEQ ID NO: 163, or SEQ ID NO: 197 and at least one of: (i) a fiber polypeptide of SEQ ID NO: 128, 162 or 196; and (ii) a penton base polypeptide of SEQ ID NO: 132, 166 or 200.

A nucleic acid sequence is therefore provided which encodes a hexon polypeptide of SEQ ID NO: 129, SEQ ID NO: 163, or SEQ ID NO: 197, wherein the nucleic acid sequence further encodes a fiber polypeptide of SEQ ID NO: 128, 162 or 196 and also a penton base polypeptide of SEQ ID NO: 132, 166 or 200.

In one example, the nucleic acid sequence encodes a hexon polypeptide of SEQ ID NO: 129 and at least one of: (i) a fiber polypeptide of SEQ ID NO: 128; and (ii) a penton base polypeptide of SEQ ID NO: 132. For example, the nucleic acid sequence may encode a hexon polypeptide of SEQ ID NO: 129, wherein the nucleic acid sequence further encodes a fiber polypeptide of SEQ ID NO: 128 and also a penton base polypeptide of SEQ ID NO: 132.

In another example, the nucleic acid sequence encodes a hexon polypeptide of SEQ ID NO: 163 and at least one of: (i) a fiber polypeptide of SEQ ID NO: 162; and (ii) a penton base polypeptide of SEQ ID NO: 166. For example, the nucleic acid sequence may encode a hexon polypeptide of SEQ ID NO: 163, wherein the nucleic acid sequence further encodes a fiber polypeptide of SEQ ID NO: 162 and also a penton base polypeptide of SEQ ID NO: 166.

In a further example, the nucleic acid sequence encodes a hexon polypeptide of SEQ ID NO: 197 and at least one of: (i) a fiber polypeptide of SEQ ID NO: 196; and (ii) a penton base polypeptide of SEQ ID NO: 200. For example, the nucleic acid sequence may encode a hexon polypeptide of SEQ ID NO: 197, wherein the nucleic acid sequence further encodes a fiber polypeptide of SEQ ID NO: 196 and also a penton base polypeptide of SEQ ID NO: 200.

In a further example, the nucleic acid sequence encodes a hexon polypeptide of SEQ ID NO: 129 and at least one of: (i) a fiber polypeptide of SEQ ID NO: 162; and (ii) a penton base polypeptide of SEQ ID NO: 132. For example, the nucleic acid sequence may encode a hexon polypeptide of SEQ ID NO: 129, wherein the nucleic acid sequence further encodes a fiber polypeptide of SEQ ID NO: 162 and also a penton base polypeptide of SEQ ID NO: 132.

In a further example, the nucleic acid sequence encodes a hexon polypeptide of SEQ ID NO: 129 and at least one of: (i) a fiber polypeptide of SEQ ID NO: 196; and (ii) a penton base polypeptide of SEQ ID NO: 132. For example, the nucleic acid sequence may encode a hexon polypeptide of SEQ ID NO: 129, wherein the nucleic acid sequence further encodes a fiber polypeptide of SEQ ID NO: 196 and also a penton base polypeptide of SEQ ID NO: 132.

In a further example, the nucleic acid sequence encodes a hexon polypeptide of SEQ ID NO: 129 and at least one of: (i) a fiber polypeptide of SEQ ID NO: 128; and (ii) a penton base polypeptide of SEQ ID NO: 166. For example, the nucleic acid sequence may encode a hexon polypeptide of SEQ ID NO: 129, wherein the nucleic acid sequence further encodes a fiber polypeptide of SEQ ID NO: 128 and also a penton base polypeptide of SEQ ID NO: 166.

In a further example, the nucleic acid sequence encodes a hexon polypeptide of SEQ ID NO: 129, and at least one of: (i) a fiber polypeptide of SEQ ID NO: 128; and (ii) a penton base polypeptide of SEQ ID NO: 200. For example, the nucleic acid sequence may encode a hexon polypeptide of SEQ ID NO: 129, wherein the nucleic acid sequence further encodes a fiber polypeptide of SEQ ID NO: 128, and also a penton base polypeptide of SEQ ID NO: 200.

In a further example, the nucleic acid sequence encodes a hexon polypeptide of SEQ ID NO: 129 and at least one of: (i) a fiber polypeptide of 162; and (ii) a penton base polypeptide of SEQ ID NO: 166. For example, the nucleic acid sequence may encode a hexon polypeptide of SEQ ID NO: 129, wherein the nucleic acid sequence further encodes a fiber polypeptide of SEQ ID NO: 162 and also a penton base polypeptide of SEQ ID NO: 166.

In a further example, the nucleic acid sequence encodes a hexon polypeptide of SEQ ID NO: 129 and at least one of: (i) a fiber polypeptide of SEQ ID NO: 196; and (ii) a penton base polypeptide of SEQ ID NO: 200. For example, the nucleic acid sequence may encode a hexon polypeptide of SEQ ID NO: 129, wherein the nucleic acid sequence further encodes a fiber polypeptide of SEQ ID NO: 196 and also a penton base polypeptide of SEQ ID NO: 200.

In a further example, the nucleic acid sequence encodes a hexon polypeptide of SEQ ID NO: 129 and at least one of: (i) a fiber polypeptide of SEQ ID NO:162; and (ii) a penton base polypeptide of SEQ ID NO: 200. For example, the nucleic acid sequence may encode a hexon polypeptide of SEQ ID NO: 129, wherein the nucleic acid sequence further encodes a fiber polypeptide of SEQ ID NO: 162 and also a penton base polypeptide of SEQ ID NO: 200.

In another example, the nucleic acid sequence encodes a hexon polypeptide of SEQ ID NO: 129 and at least one of: (i) a fiber polypeptide of SEQ ID NO: 196; and (ii) a penton base polypeptide of SEQ ID NO: 166. For example, the nucleic acid sequence may encode a hexon polypeptide of SEQ ID NO: 129, wherein the nucleic acid sequence further encodes a fiber polypeptide of SEQ ID NO: 196 and also a penton base polypeptide of SEQ ID NO: 166.

In another example, the nucleic acid sequence encodes a hexon polypeptide of SEQ ID NO: 163 and at least one of: (i) a fiber polypeptide of SEQ ID NO: 162; and (ii) a penton base polypeptide of SEQ ID NO: 132. For example, the nucleic acid sequence encoding a hexon polypeptide of SEQ ID NO: 163, wherein the nucleic acid sequence further encodes a fiber polypeptide of SEQ ID NO: 162 and also a penton base polypeptide of SEQ ID NO: 132.

In another example, the nucleic acid sequence encodes a hexon polypeptide of SEQ ID NO: 163 and at least one of: (i) a fiber polypeptide of SEQ ID NO: 196; and (ii) a penton base polypeptide of SEQ ID NO: 132. For example, the nucleic acid sequence may encode a hexon polypeptide of SEQ ID NO: 163, wherein the nucleic acid sequence further encodes a fiber polypeptide of SEQ ID NO: 196 and also a penton base polypeptide of SEQ ID NO: 132.

In another example, the nucleic acid sequence encodes a hexon polypeptide of SEQ ID NO: 163 and at least one of: (i) a fiber polypeptide of SEQ ID NO: 128; and (ii) a penton base polypeptide of SEQ ID NO: 166. For example, the nucleic acid sequence may encode a hexon polypeptide of SEQ ID NO: 163, wherein the nucleic acid sequence further encodes a fiber polypeptide of SEQ ID NO: 128 and also a penton base polypeptide of SEQ ID NO: 166.

In another example, the nucleic acid sequence encodes a hexon polypeptide of SEQ ID NO: 163, and at least one of: (i) a fiber polypeptide of SEQ ID NO: 128; and (ii) a penton base polypeptide of SEQ ID NO: 200. For example, the nucleic acid sequence may encode a hexon polypeptide of SEQ ID NO: 163, wherein the nucleic acid sequence further encodes a fiber polypeptide of SEQ ID NO: 128, and also a penton base polypeptide of SEQ ID NO: 200.

In another example, the nucleic acid sequence encodes a hexon polypeptide of SEQ ID NO: 163 and at least one of: (i) a fiber polypeptide of 162; and (ii) a penton base polypeptide of SEQ ID NO: 166. For example, the nucleic acid sequence may encode a hexon polypeptide of SEQ ID NO: 163, wherein the nucleic acid sequence further encodes a fiber polypeptide of SEQ ID NO: 162 and also a penton base polypeptide of SEQ ID NO: 166.

In another example, the nucleic acid sequence encodes a hexon polypeptide of SEQ ID NO: 163 and at least one of: (i) a fiber polypeptide of SEQ ID NO: 196; and (ii) a penton base polypeptide of SEQ ID NO: 200. For example, the nucleic acid sequence may encode a hexon polypeptide of SEQ ID NO: 163, wherein the nucleic acid sequence further encodes a fiber polypeptide of SEQ ID NO: 196 and also a penton base polypeptide of SEQ ID NO: 200.

In another example, the nucleic acid sequence encodes a hexon polypeptide of SEQ ID NO: 163 and at least one of: (i) a fiber polypeptide of SEQ ID NO:162; and (ii) a penton base polypeptide of SEQ ID NO: 200. For example, the nucleic acid sequence may encode a hexon polypeptide of SEQ ID NO: 163, wherein the nucleic acid sequence further encodes a fiber polypeptide of SEQ ID NO: 162 and also a penton base polypeptide of SEQ ID NO: 200.

In another example, the nucleic acid sequence encodes a hexon polypeptide of SEQ ID NO: 163 and at least one of: (i) a fiber polypeptide of SEQ ID NO: 196; and (ii) a penton base polypeptide of SEQ ID NO: 166. For example, the nucleic acid sequence may encode a hexon polypeptide of SEQ ID NO: 163, wherein the nucleic acid sequence further encodes a fiber polypeptide of SEQ ID NO: 196 and also a penton base polypeptide of SEQ ID NO: 166.

In another example, the nucleic acid sequence encodes a hexon polypeptide of SEQ ID NO: 197 and at least one of: (i) a fiber polypeptide of SEQ ID NO: 162; and (ii) a penton base polypeptide of SEQ ID NO: 132. For example, the nucleic acid sequence may encode a hexon polypeptide of SEQ ID NO: 197, wherein the nucleic acid sequence further encodes a fiber polypeptide of SEQ ID NO: 162 and also a penton base polypeptide of SEQ ID NO: 132.

In another example, the nucleic acid sequence encodes a hexon polypeptide of SEQ ID NO: 197 and at least one of: (i) a fiber polypeptide of SEQ ID NO: 196; and (ii) a penton base polypeptide of SEQ ID NO: 132. For example, the nucleic acid sequence may encode a hexon polypeptide of SEQ ID NO: 197, wherein the nucleic acid sequence further encodes a fiber polypeptide of SEQ ID NO: 196 and also a penton base polypeptide of SEQ ID NO: 132.

In another example, the nucleic acid sequence encodes a hexon polypeptide of SEQ ID NO: 197 and at least one of: (i) a fiber polypeptide of SEQ ID NO: 128; and (ii) a penton base polypeptide of SEQ ID NO: 166. For example, the nucleic acid sequence may encode a hexon polypeptide of SEQ ID NO: 197, wherein the nucleic acid sequence further encodes a fiber polypeptide of SEQ ID NO: 128 and also a penton base polypeptide of SEQ ID NO: 166.

In another example, the nucleic acid sequence encodes a hexon polypeptide of SEQ ID NO: 197, and at least one of: (i) a fiber polypeptide of SEQ ID NO: 128; and (ii) a penton base polypeptide of SEQ ID NO: 200. For example, the nucleic acid sequence may encode a hexon polypeptide of SEQ ID NO: 197, wherein the nucleic acid sequence further encodes a fiber polypeptide of SEQ ID NO: 128, and also a penton base polypeptide of SEQ ID NO: 200.

In another example, the nucleic acid sequence encodes a hexon polypeptide of SEQ ID NO: 197 and at least one of: (i) a fiber polypeptide of 162; and (ii) a penton base polypeptide of SEQ ID NO: 166. For example, the nucleic acid sequence may encode a hexon polypeptide of SEQ ID NO: 197, wherein the nucleic acid sequence further encodes a fiber polypeptide of SEQ ID NO: 162 and also a penton base polypeptide of SEQ ID NO: 166.

In another example, the nucleic acid sequence encodes a hexon polypeptide of SEQ ID NO: 197 and at least one of: (i) a fiber polypeptide of SEQ ID NO: 196; and (ii) a penton base polypeptide of SEQ ID NO: 200. For example, the nucleic acid sequence may encode a hexon polypeptide of SEQ ID NO: 197, wherein the nucleic acid sequence further encodes a fiber polypeptide of SEQ ID NO: 196 and also a penton base polypeptide of SEQ ID NO: 200.

In another example, the nucleic acid sequence encodes a hexon polypeptide of SEQ ID NO: 197 and at least one of: (i) a fiber polypeptide of SEQ ID NO:162; and (ii) a penton base polypeptide of SEQ ID NO: 200. For example, the nucleic acid sequence may encode a hexon polypeptide of SEQ ID NO: 197, wherein the nucleic acid sequence further encodes a fiber polypeptide of SEQ ID NO: 162 and also a penton base polypeptide of SEQ ID NO: 200.

In another example, the nucleic acid sequence encodes a hexon polypeptide of SEQ ID NO: 197 and at least one of: (i) a fiber polypeptide of SEQ ID NO: 196; and (ii) a penton base polypeptide of SEQ ID NO: 166. For example, the nucleic acid sequence may encode a hexon polypeptide of SEQ ID NO: 197, wherein the nucleic acid sequence further encodes a fiber polypeptide of SEQ ID NO: 196 and also a penton base polypeptide of SEQ ID NO: 166.

An isolated non-human primate adenovirus nucleic acid sequence is also provided herein, wherein the sequence comprises or consists of a nucleic acid sequence of SEQ ID NO: 1 and its complement.

Furthermore, an alternative isolated non-human primate adenovirus nucleic acid sequence is also provided herein, wherein the sequence comprises or consists of a nucleic acid sequence of SEQ ID NO: 36 and its complement.

Also provided is an isolated non-human primate adenovirus nucleic acid sequence, wherein the sequence comprises or consists of a nucleic acid sequence of SEQ ID NO: 71 and its complement.

Nucleic acid sequences are provided above that encode one or more polypeptides. Vectors that comprise these nucleic acid sequences are also provided. The vector may be an adenoviral vector. Preferably, the viral vector is an oncolytic adenoviral vector.

Polypeptides encoded by the described nucleic acid sequences are equally provided herein.

Subgroup C(-Like) Adenoviruses

Novel NHP adenoviruses that identify with human subgroup C adenoviruses are also described herein. The novel adenoviruses are defined by at least one novel capsid protein e.g. hexon, penton base and/or fiber (or fragments thereof e.g. HVR, tail, knob or shaft domains). The novel capsid proteins have already been described in detail in the context of nucleic acid sequences that encode them (above). The corresponding NHP adenoviruses are described in detail below.

Hexon Sequences

Isolated NHP adenoviruses are provided herein having a capsid comprising at least one capsid polypeptide, e.g. a hexon polypeptide.

The hexon polypeptide may comprise an amino acid sequence having at least 95% sequence identity to: amino acid residues 137 to 452 of SEQ ID NO: 129; amino acid residues 139 to 444 of SEQ ID NO: 163; or amino acid residues 139 to 456 of SEQ ID NO: 197. These regions of the hexon represent the hypervariable regions of the novel hexons provided herein (i.e. for NHP 002, NHP 005 and NHP 008 respectively).

The hexon polypeptide may comprise an amino acid sequence having at least 87%, at least 90%, at least 91%, at least 92%, at least 93%, at least 94%, at least 95%, at least 96%, at least 97%, at least 98%, at least 99% or 100% identity to amino acid residues 137 to 452 of SEQ ID NO: 129. Amino acid residues 137 to 452 of SEQ ID NO: 129 correspond to the HVR of novel adenovirus NHP 002 described herein.

For example, the hexon polypeptide may comprise an amino acid sequence having at least 94%, at least 95%, at least 96%, at least 97% at least 98% at least 99% or 100% identity to SEQ ID NO: 129. In other words, the hexon polypeptide may comprise an amino acid sequence that is identical to SEQ ID NO: 129.

Alternatively, the hexon polypeptide may comprise an amino acid sequence at least 76%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 444 of SEQ ID NO: 163. Amino acid residues 139 to 444 of SEQ ID NO: 163 correspond to the HVR of novel adenovirus NHP 005 described herein.

In this example, the polypeptide may comprise an amino acid sequence having at least 96%, at least 97% at least 98% at least 99% or 100% identity to SEQ ID NO: 163. In other words, the hexon polypeptide may comprise an amino acid sequence that is identical to SEQ ID NO: 163.

In an alternative example, the hexon polypeptide may comprise an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to amino acid residues 139 to 456 of SEQ ID NO: 197. Amino acid residues 139 to 456 of SEQ ID NO: 197 correspond to the HVR of novel adenovirus NHP 008 described herein.

In this example, the hexon polypeptide may comprise an amino acid sequence having at least 99.5% or 100% identity to SEQ ID NO: 197. In other words, the hexon polypeptide may comprise an amino acid sequence that is identical to SEQ ID NO: 197.

Fiber Sequences

Isolated NHP adenoviruses are also provided herein having a capsid comprising at least one capsid polypeptide, e.g. a fiber polypeptide.

The fiber polypeptide may comprise an amino acid sequence having at least 95% sequence identity to at least one of: amino acid residues 388 to 577 of SEQ ID NO: 128; amino acid residues 76 to 387 of SEQ ID NO: 128; amino acid residues 1 to 75 of SEQ ID NO: 128; amino acid residues 392 to 581 of SEQ ID NO: 162; amino acid residues 76 to 391 of SEQ ID NO: 162; amino acid residues 1 to 75 of SEQ ID NO: 162; amino acid residues 391 to 580 of SEQ ID NO: 196; amino acid residues 76 to 390 of SEQ ID NO: 196; or amino acid residues 1 to 75 of SEQ ID NO: 196. The defined amino acid regions for SEQ ID NO: 128 represent the "knob", "shaft" and "tail" domains respectively of the fiber protein for new adenovirus NHP 002 described herein; the defined amino acid regions for SEQ ID NO: 162 represent the "knob", "shaft" and "tail" domains respectively of the fiber protein for new adenovirus NHP 005 described herein; and similarly, the defined amino acid regions for SEQ ID NO: 196 represent the "knob", "shaft" and "tail" domains respectively of the fiber protein for new adenovirus NHP 008 described herein.

The fiber polypeptide may comprise an amino acid sequence having at least 73%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, two, or three of: amino acid residues 388 to 577 of SEQ ID NO: 128; amino acid residues 76 to 387 of SEQ ID NO: 128; amino acid residues 1 to 75 of SEQ ID NO: 128.

For example, the polypeptide may have at least 82% identity to residues 388 to 577 of SEQ ID NO: 128. For example, the polypeptide may have at least 73% identity to residues 76 to 387 of SEQ ID NO: 128. For example, the polypeptide may have at least 89% identity to residues 1 to 75 of SEQ ID NO: 128. For example, the fiber polypeptide may comprise an amino acid sequence having at least 78%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 128.

Alternatively, the fiber polypeptide may comprise an amino acid sequence having at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 392 to 581 of SEQ ID NO: 162; amino acid residues 76 to 391 of SEQ ID NO: 162; amino acid residues 1 to 75 of SEQ ID NO: 162. For example, the fiber polypeptide may have at least 66% identity to amino acid residues 392 to 581 of SEQ ID NO: 162. For example, the fiber polypeptide may have at least 55% to residues 76 to 391 of SEQ ID NO: 162. For example, the fiber polypeptide may have at least 77% identity to residues 1 to 75 of SEQ ID NO: 162. For example, the fiber polypeptide may comprise an amino acid sequence having at least 64%, at least 65%, at least 70%, at least 75%, at least 80%, at least 85%, at least 90%, at least 91%, at least 92%, at least 93%, at least 94%, at least 95%, 95%, at least 96%, at least 97%, at least 98%, at least 99% or 100% identity to SEQ ID NO: 162.

In another example, the fiber polypeptide may comprise an amino acid sequence having at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to at least one, at least two, or three of: amino acid residues 391 to 580 of SEQ ID NO: 196; amino acid residues 76 to 390 of SEQ ID NO: 196; or amino acid residues 1 to 75 of SEQ ID NO: 196. For example, the polypeptide may have at least 69% identity to residues 391 to 580 of SEQ ID NO: 196. For example, the polypeptide may have at least 56% identity to residues 76 to 390 of SEQ ID NO: 196. For example, the polypeptide may have at least 73% identity to residues 1 to 75 of SEQ ID NO: 196. For example, the fiber polypeptide may comprise an amino acid sequence having at least 62%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 196.

Penton Base

Isolated NHP adenoviruses are also provided herein having a capsid comprising at least one capsid polypeptide, e.g. a penton base polypeptide.

The penton base polypeptide may comprise an amino acid sequence having at least 85%, at least 90%, at least 91%, at least 92%, at least 93%, at least 94%, at least 95%, at least 96%, at least 97%, at least 98%, at least 99% or 100% identity to SEQ ID NO: 132. In other words, the penton base polypeptide may comprise an amino acid sequence that is identical to SEQ ID NO: 132.

Alternatively, the penton base polypeptide may comprise an amino acid sequence having at least 72%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 166. In other words, the penton base polypeptide may comprise an amino acid sequence that is identical to SEQ ID NO: 166.

Alternatively, the penton base polypeptide may comprise an amino acid sequence having at least 74%, at least 75%, at least 80%, at least 85%, at least 90%, at least 91%, at least 92%, at least 93%, at least 94%, at least 95%, at least 96%, at least 97%, at least 98%, at least 99% or 100% identity to SEQ ID NO: 200. In other words, the penton base polypeptide may comprise an amino acid sequence that is identical to SEQ ID NO: 200.

Combinations

Isolated NHP adenoviruses provided herein have a capsid that includes any combination (i.e. at least two, at least three etc) of the individual hexon, penton base and fiber amino acid sequences provided herein.

Accordingly, the NHP adenovirus may have a capsid that comprises a hexon polypeptide as defined herein, and at least one of: (i) a fiber polypeptide as defined herein; and (ii) a penton base polypeptide as defined herein. In one example, the NHP adenovirus may have a capsid that comprises a hexon polypeptide as defined herein, and further comprises a fiber polypeptide as defined herein and also a penton base polypeptide as defined herein.

In one example, the NHP adenovirus may have a capsid that comprises a hexon polypeptide of SEQ ID NO: 129, SEQ ID NO: 163, or SEQ ID NO: 197 and at least one of: (i) a fiber polypeptide of SEQ ID NO: 128, 162 or 196; and (ii) a penton base polypeptide of SEQ ID NO: 132, 166 or 200.

The NHP adenovirus may have a capsid that comprises a hexon polypeptide of SEQ ID NO: 129, SEQ ID NO: 163, or SEQ ID NO: 197, wherein the capsid further comprises a fiber polypeptide of SEQ ID NO: 128, 162 or 196, and also a penton base polypeptide of SEQ ID NO: 132, 166 or 200.

In one example, the NHP adenovirus has a capsid that comprises a hexon polypeptide of SEQ ID NO: 129 and at least one of: (i) a fiber polypeptide of SEQ ID NO: 128; and (ii) a penton base polypeptide of SEQ ID NO: 132. For example, the NHP adenovirus may have a capsid that comprises a hexon polypeptide of SEQ ID NO: 129, wherein the capsid further comprises a fiber polypeptide of SEQ ID NO: 128 and also a penton base polypeptide of SEQ ID NO: 132.

In another example, the NHP adenovirus has a capsid that comprises a hexon polypeptide of SEQ ID NO: 163 and at least one of: (i) a fiber polypeptide of SEQ ID NO: 162; and (ii) a penton base polypeptide of SEQ ID NO: 166. For example, the NHP adenovirus may have a capsid that comprises a hexon polypeptide of SEQ ID NO: 163, wherein the capsid further comprises a fiber polypeptide of SEQ ID NO: 162 and also a penton base polypeptide of SEQ ID NO: 166.

In a further example, the NHP adenovirus has a capsid that comprises a hexon polypeptide of SEQ ID NO: 197 and at least one of: (i) a fiber polypeptide of SEQ ID NO: 196; and (ii) a penton base polypeptide of SEQ ID NO: 200. For example, the NHP adenovirus may have a capsid that comprises a hexon polypeptide of SEQ ID NO: 197, wherein the capsid further comprises a fiber polypeptide of SEQ ID NO: 196 and also a penton base polypeptide of SEQ ID NO: 200.

In a further example, the NHP adenovirus has a capsid that comprises a hexon polypeptide of SEQ ID NO: 129 and at least one of: (i) a fiber polypeptide of SEQ ID NO: 162; and (ii) a penton base polypeptide of SEQ ID NO: 132. For example, the NHP adenovirus may have a capsid that comprises a hexon polypeptide of SEQ ID NO: 129, wherein the capsid further comprises a fiber polypeptide of SEQ ID NO: 162 and also a penton base polypeptide of SEQ ID NO: 132.

In a further example, the NHP adenovirus has a capsid that comprises a hexon polypeptide of SEQ ID NO: 129 and at least one of: (i) a fiber polypeptide of SEQ ID NO: 196; and (ii) a penton base polypeptide of SEQ ID NO: 132. For example, the NHP adenovirus may have a capsid that comprises a hexon polypeptide of SEQ ID NO: 129, wherein the capsid further comprises a fiber polypeptide of SEQ ID NO: 196 and also a penton base polypeptide of SEQ ID NO: 132.

In a further example, the NHP adenovirus has a capsid that comprises a hexon polypeptide of SEQ ID NO: 129 and at least one of: (i) a fiber polypeptide of SEQ ID NO: 128; and (ii) a penton base polypeptide of SEQ ID NO: 166. For example, the NHP adenovirus may have a capsid that comprises hexon polypeptide of SEQ ID NO: 129, wherein the capsid further comprises a fiber polypeptide of SEQ ID NO: 128 and also a penton base polypeptide of SEQ ID NO: 166.

In a further example, the NHP adenovirus has a capsid that comprises a hexon polypeptide of SEQ ID NO: 129, and at least one of: (i) a fiber polypeptide of SEQ ID NO: 128; and (ii) a penton base polypeptide of SEQ ID NO: 200. For example, the NHP adenovirus may have a capsid that comprises a hexon polypeptide of SEQ ID NO: 129, wherein the capsid further comprises a fiber polypeptide of SEQ ID NO: 128, and also a penton base polypeptide of SEQ ID NO: 200.

In a further example, the NHP adenovirus has a capsid that comprises a hexon polypeptide of SEQ ID NO: 129 and at least one of: (i) a fiber polypeptide of 162; and (ii) a penton base polypeptide of SEQ ID NO: 166. For example, the NHP adenovirus may have a capsid that comprises a hexon polypeptide of SEQ ID NO: 129, wherein the capsid further comprises a fiber polypeptide of SEQ ID NO: 162 and also a penton base polypeptide of SEQ ID NO: 166.

In a further example, the NHP adenovirus has a capsid that comprises a hexon polypeptide of SEQ ID NO: 129 and at least one of: (i) a fiber polypeptide of SEQ ID NO: 196; and (ii) a penton base polypeptide of SEQ ID NO: 200. For example, the NHP adenovirus may have a capsid that comprises a hexon polypeptide of SEQ ID NO: 129, wherein the capsid further comprises a fiber polypeptide of SEQ ID NO: 196 and also a penton base polypeptide of SEQ ID NO: 200.

In a further example, the NHP adenovirus has a capsid that comprises a hexon polypeptide of SEQ ID NO: 129 and at least one of: (i) a fiber polypeptide of SEQ ID NO:162; and (ii) a penton base polypeptide of SEQ ID NO: 200. For example, the NHP adenovirus may have a capsid that comprises a hexon polypeptide of SEQ ID NO: 129, wherein the capsid further comprises a fiber polypeptide of SEQ ID NO: 162 and also a penton base polypeptide of SEQ ID NO: 200.

In another example, the NHP adenovirus has a capsid that comprises a hexon polypeptide of SEQ ID NO: 129 and at least one of: (i) a fiber polypeptide of SEQ ID NO: 196; and (ii) a penton base polypeptide of SEQ ID NO: 166. For example, the NHP adenovirus may have a capsid that comprises a hexon polypeptide of SEQ ID NO: 129, wherein the capsid further comprises a fiber polypeptide of SEQ ID NO: 196 and also a penton base polypeptide of SEQ ID NO: 166.

In another example, the NHP adenovirus has a capsid that comprises a hexon polypeptide of SEQ ID NO: 163 and at least one of: (i) a fiber polypeptide of SEQ ID NO: 162; and (ii) a penton base polypeptide of SEQ ID NO: 132. For example, the NHP adenovirus may have a capsid that comprises a hexon polypeptide of SEQ ID NO: 163, wherein the capsid further comprises a fiber polypeptide of SEQ ID NO: 162 and also a penton base polypeptide of SEQ ID NO: 132.

In another example, the NHP adenovirus has a capsid that comprises a hexon polypeptide of SEQ ID NO: 163 and at least one of: (i) a fiber polypeptide of SEQ ID NO: 196; and (ii) a penton base polypeptide of SEQ ID NO: 132. For example, the NHP adenovirus may have a capsid that comprises a hexon polypeptide of SEQ ID NO: 163, wherein the capsid further comprises a fiber polypeptide of SEQ ID NO: 196 and also a penton base polypeptide of SEQ ID NO: 132.

In another example, the NHP adenovirus has a capsid that comprises a hexon polypeptide of SEQ ID NO: 163 and at least one of: (i) a fiber polypeptide of SEQ ID NO: 128; and (ii) a penton base polypeptide of SEQ ID NO: 166. For example, the NHP adenovirus may have a capsid that comprises a hexon polypeptide of SEQ ID NO: 163, wherein the capsid further comprises a fiber polypeptide of SEQ ID NO: 128 and also a penton base polypeptide of SEQ ID NO: 166.

In another example, the NHP adenovirus has a capsid that comprises a hexon polypeptide of SEQ ID NO: 163, and at least one of: (i) a fiber polypeptide of SEQ ID NO: 128; and (ii) a penton base polypeptide of SEQ ID NO: 200. For example, the NHP adenovirus may have a capsid that comprises a hexon polypeptide of SEQ ID NO: 163, wherein the capsid further comprises a fiber polypeptide of SEQ ID NO: 128, and also a penton base polypeptide of SEQ ID NO: 200.

In another example, the NHP adenovirus has a capsid that comprises a hexon polypeptide of SEQ ID NO: 163 and at least one of: (i) a fiber polypeptide of 162; and (ii) a penton base polypeptide of SEQ ID NO: 166. For example, the NHP adenovirus may have a capsid that comprises a hexon polypeptide of SEQ ID NO: 163, wherein the capsid further comprises a fiber polypeptide of SEQ ID NO: 162 and also a penton base polypeptide of SEQ ID NO: 166.

In another example, the NHP adenovirus has a capsid that comprises a hexon polypeptide of SEQ ID NO: 163 and at least one of: (i) a fiber polypeptide of SEQ ID NO: 196; and (ii) a penton base polypeptide of SEQ ID NO: 200. For example, the NHP adenovirus may have a capsid that comprises a hexon polypeptide of SEQ ID NO: 163, wherein the capsid further comprises a fiber polypeptide of SEQ ID NO: 196 and also a penton base polypeptide of SEQ ID NO: 200.

In another example, the NHP adenovirus has a capsid that comprises a hexon polypeptide of SEQ ID NO: 163 and at least one of: (i) a fiber polypeptide of SEQ ID NO:162; and (ii) a penton base polypeptide of SEQ ID NO: 200. For example, the NHP adenovirus may have a capsid that comprises a hexon polypeptide of SEQ ID NO: 163, wherein the capsid further comprises a fiber polypeptide of SEQ ID NO: 162 and also a penton base polypeptide of SEQ ID NO: 200.

In another example, the NHP adenovirus has a capsid that comprises a hexon polypeptide of SEQ ID NO: 163 and at least one of: (i) a fiber polypeptide of SEQ ID NO: 196; and (ii) a penton base polypeptide of SEQ ID NO: 166. For example, the NHP adenovirus may have a capsid that comprises a hexon polypeptide of SEQ ID NO: 163, wherein the capsid further comprises a fiber polypeptide of SEQ ID NO: 196 and also a penton base polypeptide of SEQ ID NO: 166.

In another example, the NHP adenovirus has a capsid that comprises a hexon polypeptide of SEQ ID NO: 197 and at least one of: (i) a fiber polypeptide of SEQ ID NO: 162; and (ii) a penton base polypeptide of SEQ ID NO: 132. For example, the NHP adenovirus may have a capsid that comprises a hexon polypeptide of SEQ ID NO: 197, wherein the capsid further comprises a fiber polypeptide of SEQ ID NO: 162 and also a penton base polypeptide of SEQ ID NO: 132.

In another example, the NHP adenovirus has a capsid that comprises a hexon polypeptide of SEQ ID NO: 197 and at least one of: (i) a fiber polypeptide of SEQ ID NO: 196; and (ii) a penton base polypeptide of SEQ ID NO: 132. For example, the NHP adenovirus may have a capsid that comprises a hexon polypeptide of SEQ ID NO: 197, wherein the capsid further comprises a fiber polypeptide of SEQ ID NO: 196 and also a penton base polypeptide of SEQ ID NO: 132.

In another example, the NHP adenovirus has a capsid that comprises a hexon polypeptide of SEQ ID NO: 197 and at least one of: (i) a fiber polypeptide of SEQ ID NO: 128; and (ii) a penton base polypeptide of SEQ ID NO: 166. For example, the NHP adenovirus may have a capsid that comprises a hexon polypeptide of SEQ ID NO: 197, wherein the capsid further comprises a fiber polypeptide of SEQ ID NO: 128 and also a penton base polypeptide of SEQ ID NO: 166.

In another example, the NHP adenovirus has a capsid that comprises a hexon polypeptide of SEQ ID NO: 197, and at least one of: (i) a fiber polypeptide of SEQ ID NO: 128; and (ii) a penton base polypeptide of SEQ ID NO: 200. For example, the NHP adenovirus may have a capsid that comprises a hexon polypeptide of SEQ ID NO: 197, wherein the capsid further comprises a fiber polypeptide of SEQ ID NO: 128, and also a penton base polypeptide of SEQ ID NO: 200.

In another example, the NHP adenovirus has a capsid that comprises a hexon polypeptide of SEQ ID NO: 197 and at least one of: (i) a fiber polypeptide of 162; and (ii) a penton base polypeptide of SEQ ID NO: 166. For example, the NHP adenovirus may have a capsid that comprises a hexon polypeptide of SEQ ID NO: 197, wherein the capsid further comprises a fiber polypeptide of SEQ ID NO: 162 and also a penton base polypeptide of SEQ ID NO: 166.

In another example, the NHP adenovirus has a capsid that comprises a hexon polypeptide of SEQ ID NO: 197 and at least one of: (i) a fiber polypeptide of SEQ ID NO: 196; and (ii) a penton base polypeptide of SEQ ID NO: 200. For example, the NHP adenovirus may have a capsid that comprises a hexon polypeptide of SEQ ID NO: 197, wherein the capsid further comprises a fiber polypeptide of SEQ ID NO: 196 and also a penton base polypeptide of SEQ ID NO: 200.

In another example, the NHP adenovirus has a capsid that comprises a hexon polypeptide of SEQ ID NO: 197 and at least one of: (i) a fiber polypeptide of SEQ ID NO:162; and (ii) a penton base polypeptide of SEQ ID NO: 200. For example, the NHP adenovirus may have a capsid that comprises a hexon polypeptide of SEQ ID NO: 197, wherein the capsid further comprises a fiber polypeptide of SEQ ID NO: 162 and also a penton base polypeptide of SEQ ID NO: 200.

In another example, the NHP adenovirus has a capsid that comprises a hexon polypeptide of SEQ ID NO: 197 and at least one of: (i) a fiber polypeptide of SEQ ID NO: 196; and (ii) a penton base polypeptide of SEQ ID NO: 166. For example, the NHP adenovirus may have a capsid that comprises a hexon polypeptide of SEQ ID NO: 197, wherein the capsid further comprises a fiber polypeptide of SEQ ID NO: 196 and also a penton base polypeptide of SEQ ID NO: 166.

Novel non-human primate adenoviruses are provided above. Isolated non-human primate adenovirus genotypes that comprise such viruses are also provided herein. Isolated non-human primate adenovirus genomes that encode such viruses are also provided herein.

Subgroup B and C Combinations

As stated herein, the specific nucleic acid and/or polypeptide sequences provided herein for various capsid proteins may be combined e.g. to form a chimeric nucleic acid sequence or chimeric adenovirus capsid. Several of these combinations are referred to throughout the application, for example, combinations of different hexon, penton and/or fiber sequences (or fragments thereof). As stated herein, these combinations may include sequences obtained from different isolates. In addition, it would be clear that these combinations may also include may include sequences obtained from different subgroups. By way of a non-limiting example, one or more sequences obtained from NHP 007 may be combined with one or more sequences obtained from NHP 002. Combinations of one or more sequences obtained from any one of NHP 007, 012, 006, 002, 005 and/or 008 are therefore contemplated and explicitly encompassed herein.

General Adenoviral Features

The adenoviruses described above may include one or more additional features or modifications, as described below.

In order to avoid damage to normal tissues resulting from the use of high dose adenoviral therapy it is preferred that when the adenovirus is used for therapeutic purposes a mutation that facilitates its replication, and hence oncolytic activity, in tumor cells but renders it essentially harmless to normal cells is included. This approach takes advantage of the observation that many of the cell growth regulatory mechanisms that control normal cell growth are inactivated or lost in neoplastic cells, and that these same growth control mechanisms are inactivated by viruses to facilitate viral replication. Thus, the deletion or inactivation of a viral gene that inactivates a particular normal cell growth control mechanism will prevent the virus from replicating in normal cells, but such viruses will replicate in and kill neoplastic cells that lack the particular growth control mechanism.

For example, normal dividing cells transiently lack the growth control mechanism, retinoblastoma (RB) tumor suppressor, that is lacking in and associated with unrestricted growth in certain neoplastic cells. The loss of retinoblastoma tumor suppressor gene (RB) gene function has been associated with the etiology of various types of tumors. The product of this tumor suppressor gene, a 105 kilodalton polypeptide called pRB or p105, is a cell-cycle regulatory protein. The pRB polypeptide inhibits cell proliferation by arresting cells at the G-phase of the cell cycle. The pRB protein is a major target of several DNA virus oncoproteins, including adenovirus E1A, which binds and inactivates pRB, and this inactivation is important in facilitating viral replication. The regions of the E1A protein binding to pRB was mapped by Whyte et al., 1988, Whyte et al., 1989. The pRB protein interacts with the E2F transcription factor, which is involved in the expression of the adenovirus E2 gene and several cellular genes, and inhibits the activity of this transcription factor (Bagchi et al. (1991) Cell 65: 1063: Bandara et al. (1991) Nature 351: 494; Chellappan et al. (1999) Proc. Natl. Acad. Sci. (U.S.A.) 89: 4549).

Consequently, an adenovirus that is "conditionally replicative" is used to refer to an adenoviral variant which lacks the capacity to complex with RB but substantially retains other essential replicative functions so as to exhibit a replication-competent phenotype in cells which are deficient in RB function (e. g., cells which are homozygous or heterozygous for substantially deleted RB alleles, cells which comprise RB alleles encoding mutant RB proteins which are essentially non-functional cells which comprise mutations that result in a lack of function of an RB protein) but will not substantially exhibit a replicative phenotype in non-replicating, non-neoplastic cells. Such conditionally replicating adenoviruses (a.k.a. 'CRAds') are also referred to as Δ24 E1A adenoviruses. The Δ24 deletion is an example of a specific deletion in HAdV5 E1A to yield a conditionally replicating adenovirus (see for example Table 6 in the examples section below, which provides the sequences for the RB-binding elements encoded by the in the E1A gene for each novel adenovirus described herein). For the avoidance of doubt, these specific sequences may be deleted from the adenovirus as the "Δ24 deletion" in order to avoid binding of E1A protein to the RB protein. In such a manner the replication of the Δ24 adenovirus is restricted to those cells in which the RB pathway is perturbed.

A functional E1 deletion or functional E3 deletion, among others may be selected. The term "functionally deleted" or "functional deletion" means that a sufficient amount of the gene region is removed or otherwise damaged, e.g., by mutation or modification, so that the gene region is no longer capable of producing functional products of gene expression.

The adenoviruses described herein may further comprise the left-end and right-end adenovirus cis-acting elements necessary for replication and encapsulation. Conventionally the linear genome is oriented in such way that the E1 transcription unit is located at the left-hand side of the linear genome and the E4 region at the right-hand side. The cis-elements necessary for replication and encapsulation may comprise an adenovirus left-end inverted terminal repeat and an adenovirus right-end inverted terminal repeat, each of which contain the origins of viral DNA replication. In addition, the cis-acting elements required may comprise the encapsulation signals which are typically located at within the first 600 nucleotides of the left-hand side of the adenovirus genome.

Pharmaceutical Compositions and Medical Uses

A pharmaceutical composition is also provided herein, wherein the composition comprises an adenovirus, genotype, genome, isolated nucleic acid sequence, vector or protein and a pharmaceutically acceptable excipient, adjuvant, diluent and/or carrier. Compositions may routinely contain pharmaceutically acceptable concentrations of salt, buffering agents, preservatives, compatible carriers, supplementary immune potentiating agents such as adjuvants and cytokines and optionally other therapeutic agents or compounds.

As used herein, "pharmaceutically acceptable" refers to a material that is not biologically or otherwise undesirable, i.e., the material may be administered to an individual along with the selected binding protein without causing any undesirable biological effects or interacting in a deleterious manner with any of the other components of the pharmaceutical composition in which it is contained.

Excipients are natural or synthetic substances formulated alongside an active ingredient (e.g. an adenovirus, genotype, genome, isolated nucleic acid sequence, vector or protein), included for the purpose of bulking-up the formulation or to confer a therapeutic enhancement on the active ingredient in the final dosage form, such as facilitating drug absorption or solubility. Excipients can also be useful in the manufacturing process, to aid in the handling of the active substance concerned such as by facilitating powder flowability or non-stick properties, in addition to aiding in vitro stability such as prevention of denaturation over the expected shelf life. Pharmaceutically acceptable excipients are well known in the art. A suitable excipient is therefore easily identifiable by one of ordinary skill in the art. By way of example, suitable pharmaceutically acceptable excipients include water, saline, aqueous dextrose, glycerol, ethanol, and the like.

Adjuvants are pharmacological and/or immunological agents that modify the effect of other agents in a formulation. Pharmaceutically acceptable adjuvants are well known in the art. A suitable adjuvant is therefore easily identifiable by one of ordinary skill in the art.

Diluents are diluting agents. Pharmaceutically acceptable diluents are well known in the art. A suitable diluent is therefore easily identifiable by one of ordinary skill in the art.

Carriers are non-toxic to recipients at the dosages and concentrations employed and are compatible with other ingredients of the formulation. The term "carrier" denotes an organic or inorganic ingredient, natural or synthetic, with which the active ingredient is combined to facilitate the application. Pharmaceutically acceptable carriers are well known in the art. A suitable carrier is therefore easily identifiable by one of ordinary skill in the art.

The pharmaceutical compositions described herein may be used for targeting to cells with a receptor for adenoviruses. "Targeting to cells with a receptor for adenoviruses" is used herein to define a cell that has a cell surface receptor that is bound and/or acts as a ligand for a capsid protein (i.e. a hexon, penton base, fiber or a fragment thereof).

The terms "individual", "subject," "host" and "patient" are used interchangeably herein and refer to any subject for whom diagnosis, treatment or therapy is desired. For the purposes of the present disclosure, the subject may be a primate, preferably a human, or another mammal, such as a dog, cat, horse, pig, goat, or bovine, and the like.

The pharmaceutical compositions described herein can be used in therapy or in a method of treating a disease or condition. The terms "treating" and "therapy" are used interchangeably herein to refer to reducing, ameliorating or eliminating one or more signs, symptoms, or effects of a disease or condition. The terms "therapy" and "treating" are used in the broadest sense and is construed to encompass any medical intervention that is intended to prevent a medical condition from occurring, or to reduce the medical condition to manifest, or to seek to cure the root cause of the disease, or any variations of the foregoing. The terms "preventing" or "prevention" is used here to refer to stopping or reducing the likelihood of the development of symptoms associated with the disease.

The pharmaceutical compositions described herein may be used to specifically treat cancer. The cancer which is treated can be prostate cancer, pancreatic cancer, blacker cancer or glioblastoma.

The pharmaceutical compositions described herein may also be formulated as a vaccine. In this instance the compositions described herein may be formulated according to methods well known in the art.

A method for treating a disease is provided herein, the method may comprise administering a pharmaceutical composition as described herein.

As used herein, the "administration" or "administering" of a pharmaceutical composition described herein to a subject includes any route of introducing or delivering to a subject which allows for the composition to perform its intended function. Administration can be carried out by any suitable route, including orally, intranasally, intraocularly, ophthalmically, parenterally (intravenously, intramuscularly, intraperitoneally, or subcutaneously), or topically. Administration includes self-administration and the administration by another. The composition can be administered as a therapeutically effective amount. As used herein, the phrase "therapeutically effective amount" means a dose or plasma concentration in a subject that provides the specific pharmacological effect for which the described compositions are administered, e.g. to treat a disease of interest in a target subject. The therapeutically effective amount may vary based on the route of administration and dosage form, the age and weight of the subject, and/or the disease or condition being treated.

Aspects of the invention are demonstrated by the following non-limiting examples.

EXAMPLES

Presented are adenoviruses isolated from non-human primates and that are intended for clinical use. The non-human primate adenoviruses are used as a basis for the generation of adenovirus-based oncolytic agents to be used in oncolytic-virus therapy, for the generation of adenovirus-based carriers of heterologous vaccines, and for the generation of gene-transfer vectors to be used in human gene therapy. The adenoviruses were isolated from stool-samples of Chimpanzee, Bonobo, Orangutan, and Western Gorilla, all held in captivity. A panel of viruses was elected for further development based on their capacity to replicate in human cells, their capacity to infect and kill human tumor cells, and their genetic distinctness from adenoviruses isolated from humans. Virus-derived nucleic acids were isolated and the full nucleotide sequences of these viruses was determined. All non-human primate (NHP) viruses are genetically distinct from all adenovirus serotypes isolated from humans. Plasmid clones carrying viral genome NHP-007 were constructed and used for generation of genetically modified variants. From these viruses, cancer-cell selective variants were generated by deletion of the codons encoding the RB-binding domain of the E1A proteins. These viruses, and the vectors derived thereof, circumvent the inactivating effects of the pre-existing immunity in the human recipients that resulted from previous, often asymptomatic, exposure to the type of adenovirus from which the therapeutic agent was derived. They therefore constitute new viral agents that can be used in therapeutic applications in oncology, as carriers of heterologous vaccines, and as carriers of transgenes in therapeutic gene-therapy strategies.

Experimental Section

To isolate new adenoviruses, stool samples were obtained from Chimpanzee (*Pan troglodytes*), Bonobo (*Pan paniscus*), Western Gorilla (*Gorilla gorilla*), and Orangutan (*Pongo pygmaeus*), held in captivity in zoos. Viruses were isolated essentially as described by Roy et al., (2009). Fecal aliquots of 250-500 mg fecal were resuspended in 5 mL phosphate-buffered saline without Ca2+ and Mg2+(PBS−−) by thorough vortexing (3×20 sec) on a vortex mixer. The suspension was cleared by centrifugation for 5 min in a tabletop centrifuge at 6000×g. From the cleared suspension 4 mL was isolated an passed two times through a 0.45 μm low-protein binding filter. The filtrate was collected and stored at −20° C. until further use.

From each of the filtrates 100 μL and 10 μL aliquots were added to cultures of HER 911 cells (Fallaux et al., 1996) grown in 6-well plates in DMEM supplemented with 8% Fetal Bovine serum (FBS), Penicillin (100 IU/mL), Strep (100 μg/mL), Gentamicin (200 ug/mL), and Fungizone (2 μg/mL). The cultures were inspected every other day for signs of cytopathic effects (CPE). CPE typically appeared between 4 and 21 days after exposure to the filtrate. When >10% of the cells exhibited CPE, the cells were harvested by flushing the cells from the dish with the medium and collected in a 10 mL polypropylene tube. The cells in the medium were lysed by freeze/thawing three times, after which the cell debris was pelleted by centrifugation in a tabletop centrifuge for 3 min at 6000×g. From the cell lysate 200 μL was added to a fresh near-confluent culture of HER911 cells grown on 9 cm dish in DMEM supplemented with 8% FBS, Penicillin (100 IU/mL), Streptomycin (100 μg/mL), Gentamicin (200 μg/mL), and Fungizone (2 ug/mL). When CPE was nearly complete, the medium with the cells was collected and the cells were lysed by three cycles of freeze/thawing. The lysates were cleared by centrifugation in a tabletop centrifuge for 3 min at 6000×g. The lysates were stored at −20° C.

From these data the inventors concluded that the inventors has isolated viral agents that can replicate in the human HER911 cells. To confirm that these lysates contain adenoviruses, near confluent cultures of HER911 cells in 6 cm dishes were exposed to 100 μL of the virus-containing supernatant. At 2-6 days post infection, all of the cultures exhibited marked CPE. The cells were collected in the medium and subjected to a HIRT extraction procedure optimized for adenovirus DNA isolation. The cells were pelleted by centrifugation for 5 min at 1500×g for 3 minutes. The pellet was washed once in PBS and subsequently 600 μL lysis mix (10 mM Tris-HCl pH 7.5, 10 mM EDTA, 0.6% SDS) was added and the cell pellet was gently resuspended. Subsequently 150 μL 5M NaCl was added and the tube was left overnight at 4° C. The next day, 600 μL isopropanol was added and after gentle mixing the tubes were kept a room temperature for 15 min. Subsequently the tube was spun at 16,000×g for 30 minutes at room temperature. The pellet was resuspended in 40 μl 10 mM Tris, 1 mM EDTA with RNase (50 μg RNase/mL) and incubated at 37° C. for 20 min. Subsequently the samples were treated with proteinase K, and cleaned by phenol/chloroform extraction according to standard techniques.

Approximately 10 ng of the DNA was used for PCR amplification of het Hexon variable regions using the following primers: 5'-CAGGATGCTTCGGAGTACCTGAG-3' (deg Hexon for.) (SEQ ID NO: 210), and 5'-TTGGCNGG-DATDGGGTAVAGCATGTT-3' (deg Hexon rev.) (SEQ ID NO: 211), in which the 'N' is used to indicate any base, 'D' indicates A, G, or T, and 'V' denotes A, C, or G. These primers were chosen to match the consensus DNA sequences encoding the constant regions flanking the hypervariable regions of the hexon proteins of the human and non-human primate adenoviruses. The use of these primers in a standard PCR reaction (30 sec 55° C., 1 min 72° C., 1 min 95° C.), yielded a signal in all samples, but not in a DNA extract of non-infected HER911 cell. This indicated that all of the stool extracts contain adenoviruses. Sequence analyses of the PCR products revealed a variety of sequences. A selection of twelve distinct sequences were chosen for further study, and indicated with LUMC NHP-001 through LUMC NHP-012.

To verify that this selection of viruses were capable of efficient replication in HER911 cells, the inventors quantitated the yield of viruses in the 911 cultures in a standard plaque assay. Dilutions of the virus-containing lysates were used to infect near-confluent cultures of 911 cells in DMEM medium containing 2% FBS, 2-4 hrs post infection the medium was replaced by MEM medium with 0.65% agarose. The development of plaques was monitored at regular intervals, and plaques were counted until the plaque number reached a plateau. All of the viruses formed readily detectable plaques (FIG. 1) with kinetics similar to the development of plaques with human adenovirus type 5 (HAdV5), which was included in the experiment to serve as a reference. The final yield differed considerably in the different isolates, which can be attributed to the use of non-optimized conditions for the production of the initial stocks (Table 1).

TABLE 1

Functional adenovirus titers of the crude lysates harvested at three days post-infection of near-confluent cultures of HER911 cells. The adenovirus yields were determined by plaque assay on HER911 cells held under an agar overlay. The virus titers were read 9 days post infection.

| Virus | Titer (PFU/mL) |
|---|---|
| HAdV5 | 9.75E+08 |
| NHP_001 | 1.55E+08 |
| NHP_002 | 1.40E+08 |
| NHP_003 | 3.60E+08 |
| NHP_004 | 2.78E+08 |
| NHP_005 | 1.88E+07 |
| NHP_006 | 2.05E+09 |
| NHP_007 | 1.20E+09 |
| NHP_008 | 2.25E+08 |
| NHP_009 | 7.75E+07 |
| NHP_010 | 1.23E+08 |
| NHP_011 | 4.23E+08 |
| NHP_012 | 1.08E+09 |

To evaluate the potential use of these adenoviruses, a seed batch of virus was produced on 2-T75 tissue culture flasks for each of the virus isolates. The cleared freeze-thaw lysates were aliquoted and stored until further use. Each of the 12 isolates was tested on a panel of tumor cells consisting of glioblastoma cells, prostate cancer cells, pancreatic cancer cells and bladder cancer cells using an MOI of 5 and 25. The viability of the cultures was read after 72 and 120 hrs post-infection (Table 2 and Table 3).

The following cell lines were used: Glioblastoma: GS343peri, GS304, GS203, GS281, GS324core, GS245, GS186core, GS452, GS365, and GS436; Bladder cancer: T24, HCV29, TCCsup, RT4, J82, 5637, and UMUC3Luc2; Pancrease cancer: PatuS, HPAF-II, Mia-PaCa2, RLT-PSC, BxPC3, PatuT, and PANC-1; and Prostate cancer: 22RVI, C42B4, Pro4Luc2, Du145, and PnT2C2.

TABLE 2

Cell viability at MOI 25 and 5 dpi for glioblastoma, bladder, prostate, and pancreatic cancer.

| Tumor type | Cell line | Viruses | | | | | | |
|---|---|---|---|---|---|---|---|---|
| | | HAdV5 | NHP_001 | NHP_002 | NHP_003 | NHP_004 | NHP_005 | NHP_006 |
| Glioblastoma | GS343peri | 1.32 | 1.63 | 1.53 | 1.77 | 1.60 | 2.46 | 1.80 |
| | GS304 | 0.78 | 1.18 | 1.03 | 1.22 | 1.09 | 1.19 | 1.28 |
| | GS203 | 0.50 | 0.77 | 0.60 | 0.88 | 0.89 | 0.96 | 1.17 |
| | GS281 | 0.51 | 0.78 | 0.63 | 0.90 | 0.86 | 1.18 | 1.02 |
| | GS324core | 0.30 | 0.85 | 0.67 | 1.06 | 1.00 | 0.96 | 1.23 |
| | GS245 | 0.82 | 0.93 | 0.73 | 0.90 | 0.78 | 0.84 | 0.73 |
| | GS186core | 0.35 | 0.85 | 0.76 | 0.96 | 0.76 | 0.43 | 0.78 |
| | GS452 | 0.35 | 0.60 | 0.59 | 0.65 | 0.75 | 0.90 | 0.73 |
| | GS365 | 0.42 | 0.44 | 0.32 | 0.51 | 0.46 | 0.87 | 0.57 |
| | GS436 | 0.07 | 0.25 | 0.15 | 0.27 | 0.29 | 0.26 | 0.39 |
| Bladder | T24 | 0.84 | 0.87 | 1.00 | 0.99 | 1.06 | 0.76 | 0.41 |
| | HCV29 | 0.93 | 0.90 | 1.01 | 0.99 | 0.99 | 0.78 | 0.16 |
| | TCCsup | 0.57 | 0.33 | 0.47 | 0.52 | 0.80 | 0.48 | 0.29 |
| | RT4 | 0.24 | 0.32 | 0.25 | 0.35 | 0.58 | 0.53 | 0.05 |
| | J82 | 0.16 | 0.10 | 0.14 | 0.63 | 0.47 | 0.28 | 0.05 |
| | 5637 | 0.14 | 0.13 | 0.20 | 0.19 | 0.26 | 0.23 | 0.18 |
| | UMUC3Luc2 | 0.03 | 0.03 | 0.10 | 0.07 | 0.15 | 0.06 | 0.22 |
| Pancreas | PatuS | 0.77 | 0.38 | 0.51 | 0.77 | 0.61 | 0.26 | 0.45 |
| | HPAF-II | 1.04 | 0.26 | 0.45 | 0.62 | 0.75 | 0.42 | 0.16 |
| | MiA-PaCa2 | 0.12 | 0.22 | 0.40 | 0.56 | 0.42 | 0.16 | 0.42 |
| | RLT-PSC | 0.14 | 0.08 | 0.22 | 0.20 | 0.25 | 0.12 | 0.40 |
| | BxPC3 | 0.29 | 0.14 | 0.19 | 0.27 | 0.25 | 0.24 | 0.14 |
| | PatuT | 0.07 | 0.06 | 0.12 | 0.15 | 0.17 | 0.14 | 0.49 |
| | PANC-1 | 0.06 | 0.09 | 0.26 | 0.25 | 0.33 | 0.08 | 0.13 |
| Prostate | 22RVI | 0.21 | 0.12 | 0.44 | 0.14 | 0.47 | 0.13 | 0.31 |
| | C42B4 | 0.06 | 0.08 | 0.17 | 0.25 | 0.21 | 0.08 | 0.10 |
| | Pro4Luc2 | 0.04 | 0.10 | 0.17 | 0.13 | 0.13 | 0.14 | 0.09 |
| | Du145 | 0.05 | 0.06 | 0.13 | 0.14 | 0.13 | 0.19 | 0.08 |
| | PnT2C2 | 0.03 | 0.03 | 0.07 | 0.03 | 0.06 | 0.09 | 0.05 |

| Tumor type | Cell line | Viruses | | | | | |
|---|---|---|---|---|---|---|---|
| | | NHP_007 | NHP_008 | NHP_009 | NHP_010 | NHP_011 | NHP_012 |
| Glioblastoma | GS343peri | 1.94 | 2.54 | 1.73 | 1.84 | 1.98 | 2.34 |
| | GS304 | 1.35 | 1.34 | 1.50 | 1.36 | 1.44 | 1.50 |
| | GS203 | 1.15 | 1.05 | 0.87 | 1.03 | 1.05 | 1.16 |
| | GS281 | 0.90 | 1.25 | 0.98 | 1.01 | 1.05 | 0.86 |
| | GS324core | 0.35 | 1.42 | 1.19 | 1.21 | 1.28 | 0.35 |
| | GS245 | 0.69 | 0.83 | 0.86 | 0.81 | 0.87 | 0.73 |
| | GS186core | 0.70 | 1.00 | 0.86 | 0.89 | 0.83 | 0.54 |
| | GS452 | 0.64 | 0.97 | 0.66 | 0.68 | 0.63 | 0.57 |
| | GS365 | 0.44 | 1.13 | 0.55 | 0.53 | 0.57 | 0.52 |
| | GS436 | 0.13 | 0.42 | 0.21 | 0.26 | 0.23 | 0.10 |
| Bladder | T24 | 0.20 | 1.12 | 0.89 | 1.00 | 0.93 | 0.07 |
| | HCV29 | 0.13 | 1.02 | 0.89 | 0.99 | 1.01 | 0.22 |
| | TCCsup | 0.36 | 0.49 | 0.29 | 0.39 | 0.43 | 0.17 |
| | RT4 | 0.01 | 0.57 | 0.36 | 0.41 | 0.20 | 0.03 |
| | J82 | 0.02 | 0.69 | 0.12 | 0.17 | 0.32 | 0.01 |
| | 5637 | 0.05 | 0.34 | 0.10 | 0.17 | 0.10 | 0.07 |
| | UMUC3Luc2 | 0.13 | 0.23 | 0.06 | 0.10 | 0.06 | 0.05 |
| Pancreas | PatuS | 0.30 | 0.78 | 0.45 | 0.82 | 0.57 | 0.24 |
| | HPAF-II | 0.04 | 1.01 | 0.33 | 1.06 | 0.46 | 0.13 |
| | MiA-PaCa2 | 0.26 | 1.21 | 0.36 | 0.91 | 0.24 | 0.15 |
| | RLT-PSC | 0.10 | 0.68 | 0.15 | 0.30 | 0.18 | 0.16 |
| | BxPC3 | 0.05 | 0.37 | 0.20 | 0.34 | 0.21 | 0.09 |
| | PatuT | 0.05 | 0.77 | 0.11 | 0.32 | 0.18 | 0.11 |
| | PANC-1 | 0.04 | 0.48 | 0.12 | 0.28 | 0.19 | 0.08 |
| Prostate | 22RVI | 0.07 | 0.65 | 0.06 | 0.33 | 0.07 | 0.30 |
| | C42B4 | 0.05 | 1.09 | 0.08 | 0.47 | 0.09 | 0.07 |
| | Pro4Luc2 | 0.04 | 0.32 | 0.10 | 0.19 | 0.07 | 0.04 |
| | Du145 | 0.03 | 0.23 | 0.08 | 0.11 | 0.07 | 0.04 |
| | PnT2C2 | 0.01 | 0.10 | 0.05 | 0.05 | 0.02 | 0.04 |

TABLE 3

Classified cell-viability score at MOI 25 and 5 dpi for glioblastoma, bladder, prostate, and pancreatic
cancer cells upon NHP addition (Cell viability of >75% corresponds to an oncolytic efficacy score of
0; cell viability of <75%-50% corresponds to an oncolytic efficacy score of 1; cell viability of <50%-
25% corresponds to an oncolytic efficacy score of 2 and <25% corresponds to an oncolytic efficacy score of 3.

| Tumor type | Cell line | Viruses | | | | | | |
|---|---|---|---|---|---|---|---|---|
| | | HAdV5 | NHP_001 | NHP_002 | NHP_003 | NHP_004 | NHP_005 | NHP_006 |
| Glioblastoma | GS343peri | 0 | 0 | 0 | 0 | 0 | 0 | 0 |
| | GS304 | 0 | 0 | 0 | 0 | 0 | 0 | 0 |
| | GS203 | 1 | 0 | 1 | 0 | 0 | 0 | 0 |
| | GS281 | 1 | 0 | 1 | 0 | 0 | 0 | 0 |
| | GS324core | 2 | 0 | 1 | 0 | 0 | 0 | 0 |
| | GS245 | 0 | 0 | 1 | 0 | 0 | 0 | 1 |
| | GS186core | 2 | 0 | 0 | 0 | 0 | 2 | 0 |
| | GS452 | 2 | 1 | 1 | 1 | 0 | 0 | 1 |
| | GS365 | 2 | 2 | 2 | 1 | 2 | 0 | 1 |
| | GS436 | 3 | 2 | 3 | 2 | 2 | 2 | 2 |
| Bladder | T24 | 0 | 0 | 0 | 0 | 0 | 0 | 2 |
| | HCV29 | 0 | 0 | 0 | 0 | 0 | 0 | 3 |
| | TCCsup | 1 | 2 | 2 | 1 | 1 | 2 | 2 |
| | RT4 | 3 | 2 | 3 | 2 | 1 | 1 | 3 |
| | J82 | 3 | 3 | 3 | 1 | 2 | 2 | 3 |
| | 5637 | 3 | 3 | 3 | 3 | 2 | 3 | 3 |
| | UMUC3Luc2 | 3 | 3 | 3 | 3 | 3 | 3 | 3 |
| Pancreas | PatuS | 0 | 2 | 1 | 0 | 1 | 2 | 2 |
| | HPAF-II | 0 | 2 | 2 | 1 | 0 | 2 | 3 |
| | Mia-PaCa2 | 3 | 3 | 2 | 1 | 2 | 3 | 2 |
| | RLT-PSC | 3 | 3 | 3 | 3 | 3 | 3 | 2 |
| | BxPC3 | 2 | 3 | 3 | 2 | 3 | 3 | 3 |
| | PatuT | 3 | 3 | 3 | 3 | 3 | 3 | 2 |
| | PANC-1 | 3 | 3 | 2 | 3 | 2 | 3 | 3 |
| Prostate | 22RVI | 3 | 3 | 2 | 3 | 2 | 3 | 2 |
| | C42B4 | 3 | 3 | 3 | 2 | 3 | 3 | 3 |
| | Pro4Luc2 | 3 | 3 | 3 | 3 | 3 | 3 | 3 |
| | Du145 | 3 | 3 | 3 | 3 | 3 | 3 | 3 |
| | PnT2C2 | 3 | 3 | 3 | 3 | 3 | 3 | 3 |

| Tumor type | Cell line | Viruses | | | | | |
|---|---|---|---|---|---|---|---|
| | | NHP_007 | NHP_008 | NHP_009 | NHP_010 | NHP_011 | NHP_012 |
| Glioblastoma | GS343peri | 0 | 0 | 0 | 0 | 0 | 0 |
| | GS304 | 0 | 0 | 0 | 0 | 0 | 0 |
| | GS203 | 0 | 0 | 0 | 0 | 0 | 0 |
| | GS281 | 0 | 0 | 0 | 0 | 0 | 0 |
| | GS324core | 2 | 0 | 0 | 0 | 0 | 2 |
| | GS245 | 1 | 0 | 0 | 0 | 0 | 1 |
| | GS186core | 1 | 0 | 0 | 0 | 0 | 1 |
| | GS452 | 1 | 0 | 1 | 1 | 1 | 1 |
| | GS365 | 2 | 0 | 1 | 1 | 1 | 1 |
| | GS436 | 3 | 2 | 3 | 2 | 3 | 3 |
| Bladder | T24 | 3 | 0 | 0 | 0 | 0 | 3 |
| | HCV29 | 3 | 0 | 0 | 0 | 0 | 3 |
| | TCCsup | 2 | 2 | 2 | 2 | 2 | 3 |
| | RT4 | 3 | 1 | 2 | 2 | 3 | 3 |
| | J82 | 3 | 1 | 3 | 3 | 2 | 3 |
| | 5637 | 3 | 2 | 3 | 3 | 3 | 3 |
| | UMUC3Luc2 | 3 | 3 | 3 | 3 | 3 | 3 |
| Pancreas | PatuS | 2 | 0 | 2 | 0 | 1 | 3 |
| | HPAF-II | 3 | 0 | 2 | 0 | 2 | 3 |
| | Mia-PaCa2 | 2 | 0 | 2 | 0 | 3 | 3 |
| | RLT-PSC | 3 | 1 | 3 | 2 | 3 | 3 |
| | BxPC3 | 3 | 2 | 3 | 2 | 3 | 3 |
| | PatuT | 3 | 0 | 3 | 2 | 3 | 3 |
| | PANC-1 | 3 | 2 | 3 | 2 | 3 | 3 |
| Prostate | 22RVI | 3 | 1 | 3 | 2 | 3 | 2 |
| | C42B4 | 3 | 3 | 3 | 2 | 3 | 3 |
| | Pro4Luc2 | 3 | 2 | 3 | 3 | 3 | 3 |
| | Du145 | 3 | 3 | 3 | 3 | 3 | 3 |
| | PnT2C2 | 3 | 3 | 3 | 3 | 3 | 3 |

One day prior to infection, cells were seeded at 5000 cells/well in a 96-well flat-bottom tissue culture plate in DMEM supplemented with 10% FBS or cell-specific culture medium. Plates for the patient-derived glioblastoma cell lines were coated with Matrigel before seeding. Cell lines were exposed to each of the NHP virus isolates, and as a control, HAdV5. Each of the viruses was evaluated at MOI 5 and 25 in the appropriate culture medium with 2% FBS. As additional controls non-infected and background controls (culture medium without any cells) were included. All conditions were performed in triplicate. Cell viability was determined 120 hrs post infection by WST-1 cell proliferation reagent kit WST-1 (Merck) according to the manufacturer's protocol.

There is a considerable variety in the cell viability of the NHP adenovirus infected cultures for the cell lines tested. Some virus-exposed cell lines exhibit an increase in the cell viability reading, which can be attributed to the cell-cycle and metabolism promoting effects of the viral infection. This increase is often seen to precede the decrease that is the result of virus-induced cell death. In general the prostate cancer cell lines appear most sensitive to virus-induced oncolysis, followed by pancreas and bladder cancer cell lines (Table 3). The glioblastoma cell lines were relatively insensitive to adenoviral infection except for one cell line (GS436). Two bladder cancer cell lines (T24 and HCV29) were selectively killed by NHP_006, NHP_007, and NHP_012. When scoring the NHP isolates for their oncolytic potential (Table 3: negligible effect (<75% cell viability)=0 pts; minor effect (>75%-50%<cell viability)=1 pts; moderate effect (>50%-25%<cell viability)=2 pts; and strong effect (>25 cell viability)=3 pts) the top 3 candidates were NHP_012 (65 pts), NHP_007 (64 pts), and NHP_002 (57 pts) (Table 4). Surprisingly, all three outperformed HAd5 (55 pts). When considering the top 3 candidates, no other isolate attributed to the scope of cancer cell lines that could be targeted apart from NHP_005, which demonstrated the strongest oncolytic effect (moderate) in the GS186core glioblastoma cell line of all NHP isolates. Therefore, the inventors elected NHP_012, NHP_007, NHP_002 as well as NHP_005 as our initial candidates for further development as oncolytic vectors.

Table 4

Summed oncolytic efficacy scores per virus.

| Virus | None | Minor | Moderate | Strong | Total (pts) |
|---|---|---|---|---|---|
| NHP_012 | 4 | 4 | 2 | 19 | 65 |
| NHP_007 | 4 | 3 | 5 | 17 | 64 |
| NHP_002 | 4 | 6 | 6 | 13 | 57 |
| HAdV5 | 7 | 3 | 5 | 14 | 55 |
| NHP_006 | 6 | 3 | 8 | 12 | 55 |
| NHP_001 | 9 | 1 | 6 | 13 | 52 |
| NHP_009 | 9 | 2 | 5 | 13 | 51 |
| NHP_011 | 9 | 3 | 3 | 14 | 51 |
| NHP_005 | 10 | 1 | 6 | 12 | 49 |
| NHP_003 | 10 | 6 | 4 | 9 | 41 |
| NHP_004 | 12 | 2 | 7 | 8 | 40 |
| NHP_010 | 12 | 2 | 9 | 6 | 38 |
| NHP_008 | 16 | 4 | 6 | 3 | 25 |

Figure 3:
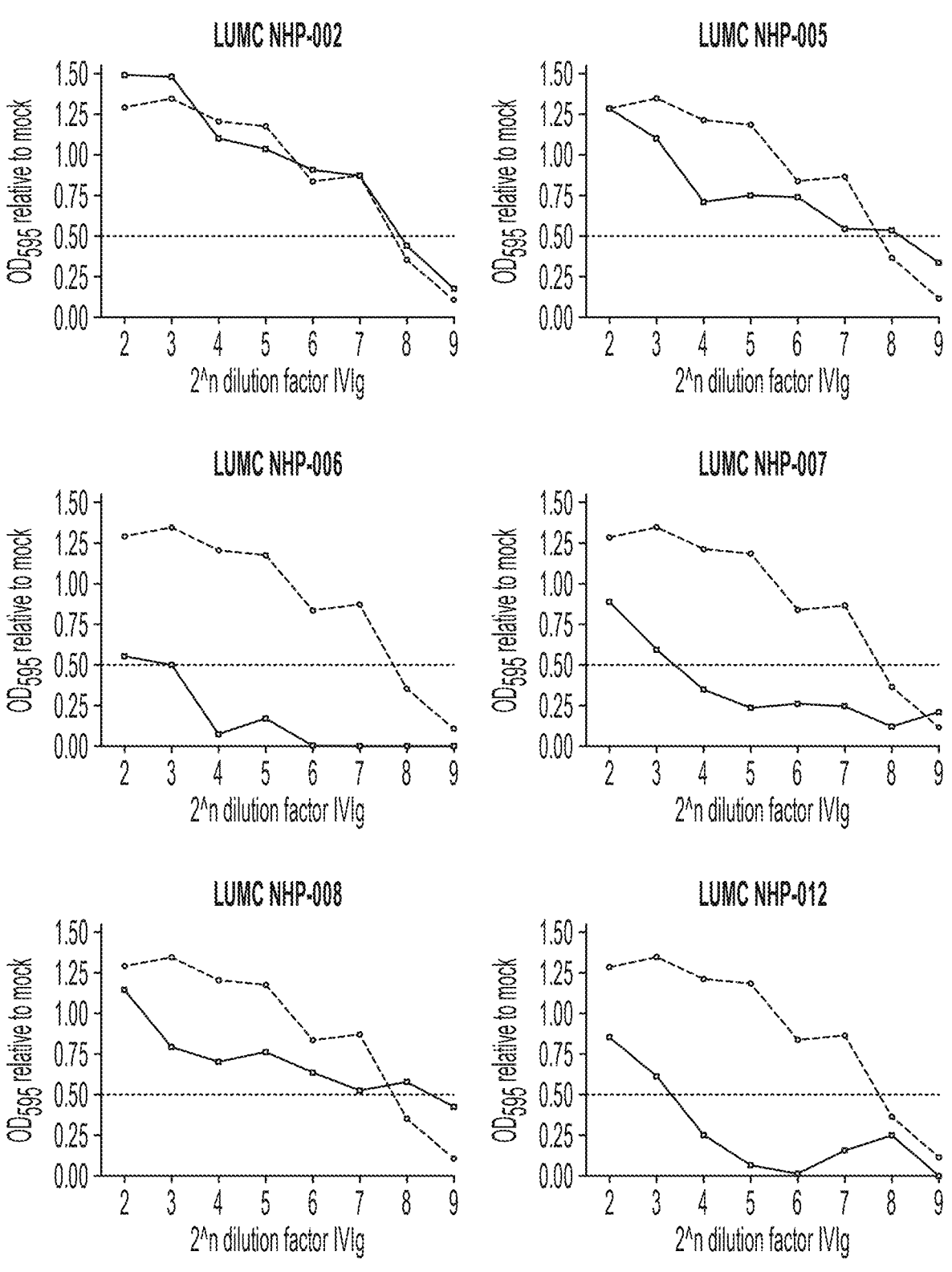
FIG. 3 shows a neutralisation assay. To test whether the human humoral immunity is capable of recognizing the NHP-derived adenoviruses the inventors evaluated whether pooled human IgG preparation derived from usually more than 1000 donations were capable of neutralizing the elected NHP_002, 005, 006, 007, 008 and 012 viruses. One day prior to titration, HER911 cells were seeded in 96-well tissue culture plate. On the day of infection, a 2-fold dilution-series of Nanogam® (Sanquin, Amsterdam, Netherlands) was prepared starting at 2.5 mg/mL (1:4) in DMEM supplemented with 2% horse serum (HS). Each dilution was mixed with 100 plaque forming units (PFU) of virus in a 1:1 volume and incubated for 45 min at 37° C. to allow the antibodies to bind virus. Virus without Nanogam was used as a control. Culture medium was removed from the HER911 cells and replaced by 100 μL IVIg:virus dilution. Each condition was tested in triplo. Cell survival was read after crystal violet staining at 4 days post infection. The amount of crystal violet bound was read by absorbance at 595 nm after dissolving the dye in methanol. The experiment was performed in triplicate, and the average of the three readings was shown.

To test whether the human humoral immunity is capable of recognizing the NHP-derived adenoviruses, the inventors evaluated whether pooled human IgG preparation derived from usually more than 1000 donations were capable of neutralizing the elected NHP_002, 005, 006, 007, 008 and 012 viruses. One day prior to titration, HER911 cells were seeded in 96-well flat-bottom tissue culture plate. On the day of infection, a 2-fold dilution-series of Nanogam® (Sanquin, Amsterdam, Netherlands) was prepared starting at 2.5 mg/mL (1:4) in DMEM supplemented with 2% horse serum (HS). Each dilution was mixed with 100 plaque forming units (PFU) of virus in a 1:1 volume and incubated for 45 min at 37° C. to allow the antibodies to bind virus. Virus without Nanogam was used as a control. Culture medium was removed from the HER911 cells and replaced by 100 μL IVIg:virus dilution. Cell survival was read after crystal violet staining at 4 days post infection. The amount of crystal violet bound was read by absorbance at 595 nm after dissolving the dye in methanol. The experiment was performed in triplicate, and the average of the three readings was shown (FIG. 3).

The NHP-Ads demonstrated variable neutralization by the pooled human immunoglobulin. Neutralization efficacy was determined by the dilution factor at which the oncolytic efficacy (measured by the amount of adherent cells) was reduced by 50%. Infection by subgroup C viruses, which include NHP-002, NHP-005, and NHP-008, was inhibited at higher dilutions (ranging from 1/256 to 1/1024) and was comparable to the results obtained for wtHAd5. However, infection by subgroup B viruses, which include NHP-006, NHP-007, and NHP-012, was inhibited at much lower dilutions (ranging from 1/8 to 1/32). Concentrations exceeding a 1:10 dilution are no not predicted to be representative for the IVIg concentrations which can be found in the blood. Therefore it seems plausible that there exists limited pre-existing immunity in the population against NHP-006, NHP-007, and NHP-012. In light of these results, the subgroup B NHP-Ads appear the most promising OV candidates for further development.

To further characterize the shortlist viruses the nucleotide sequence was determined from de adenovirus genomes. To this end virus DNA was isolated from HER911 cell cultures by HIRT extraction and analyzed by sequencing on an illumine platform. The viral genomes were assembled de novo and the viral genes were annotated by comparing the DNA sequences comparisons with the adenovirus genomes annotated in the Genbank nucleotide databases at NCBI (www.ncbi.nlm.nih.gov/nuccore/).

TABLE 5

Figure 2:
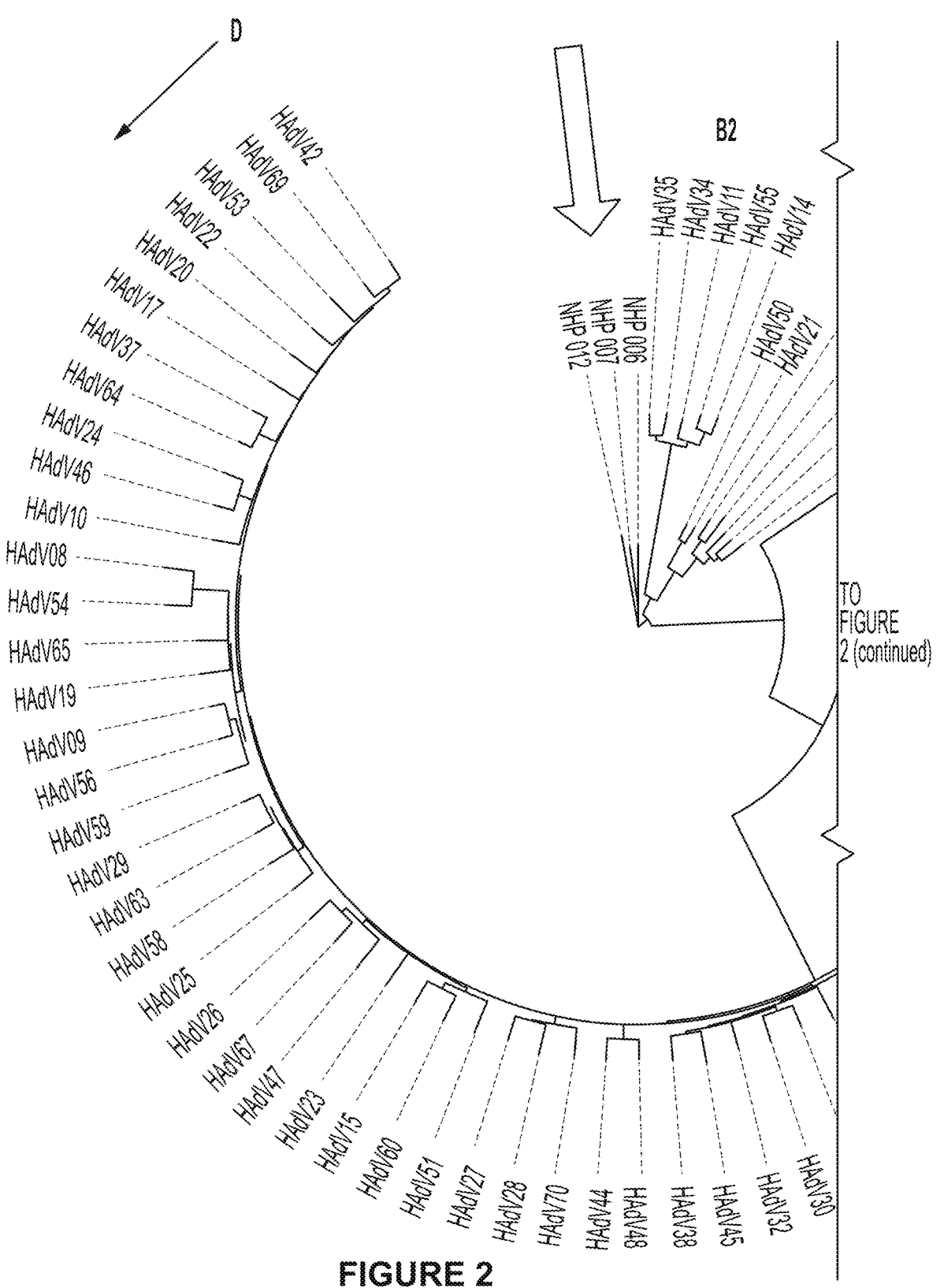
FIG. 2 shows a phylogenetic tree in which the six NHP-AdV isolates have been indicated. For tentatively assigning the adenovirus isolates to the subgroup levels, the nucleotide sequences of the NHP_002, 005, 006, 007, 008 and 012 isolates were aligned with a representative full genome nucleotide sequences of each of the human types HAdV-01 to HAdV-71.
Figure 2:
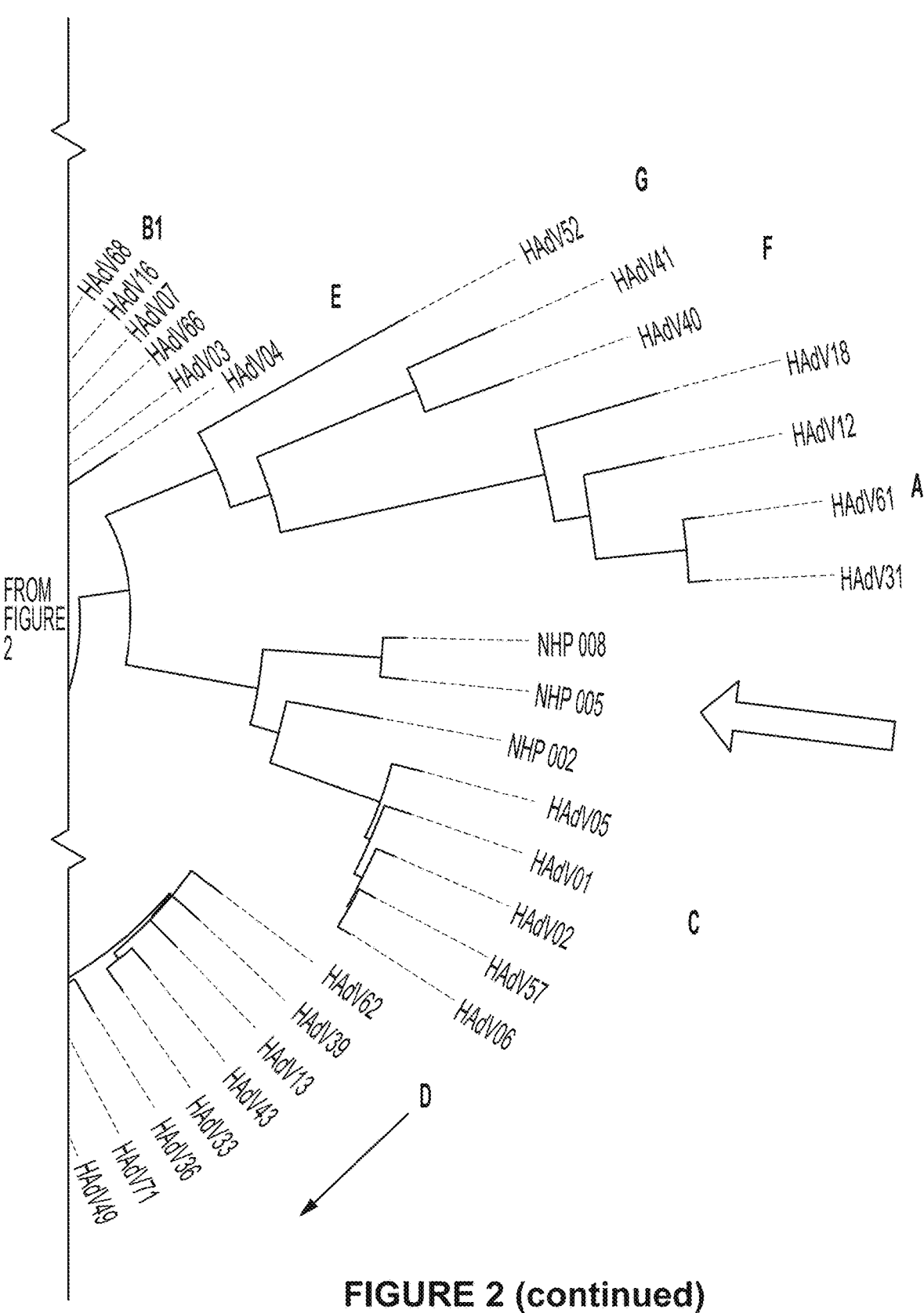

Genbank accession numbers of the full-length nucleotide sequences of the adenoviruses used to generate the phylogenetic tree of FIG. 2.

| Adenovirus type | | Genbank Accesion Number |
|---|---|---|
| HAdV | 01 | AC00017 |
| HAdV | 02 | BK000407 |
| HAdV | 03 | NC_011203 |
| HAdV | 04 | AY458656 |
| HAdV | 05 | BK000408 |
| HAdV | 06 | FJ349096 |
| HAdV | 07 | BK005235 |
| HAdV | 08 | KP016723 |
| HAdV | 09 | NC_010956 |
| HAdV | 10 | JN226746 |
| HAdV | 11 | NC_011202 |
| HAdV | 12 | X73487 |
| HAdV | 13 | JN226747 |
| HAdV | 14 | AY803294 |
| HAdV | 15 | AB562586 |
| HAdV | 16 | JN860680 |
| HAdV | 17 | AF108105 |
| HAdV | 18 | GU191019 |
| HAdV | 19 | JQ326209 |
| HAdV | 20 | JN226749 |
| HAdV | 21 | KF528668 |
| HAdV | 22 | JF619037 |
| HAdV | 23 | JN226750 |
| HAdV | 24 | JN226751 |
| HAdV | 25 | JN226752 |
| HAdV | 26 | JF153474 |
| HAdV | 27 | JN226753 |
| HAdV | 28 | JF824826 |
| HAdV | 29 | JN226754 |
| HAdV | 30 | JN226755 |
| HAdV | 31 | AM749299 |
| HAdV | 32 | JN226756 |
| HAdV | 33 | JN226758 |
| HAdV | 34 | AY737797 |

57

TABLE 5-continued

Genbank accession numbers of the full-length nucleotide sequences of
the adenoviruses used to generate the phylogenetic tree of FIG. 2.

| Adenovirus type | | Genbank Accesion Number |
|---|---|---|
| HAdV | 35 | AC_000019 |
| HAdV | 36 | GQ384080 |
| HAdV | 37 | AB448778 |
| HAdV | 38 | JN226759 |
| HAdV | 39 | JN226760 |
| HAdV | 40 | KU162869 |
| HAdV | 41 | DQ315364 |
| HAdV | 42 | JN226761 |
| HAdV | 43 | JN226762 |
| HAdV | 44 | JN226763 |
| HAdV | 45 | JN226764 |
| HAdV | 46 | AY875648 |
| HAdV | 47 | JN226757 |
| HAdV | 48 | JF153473 |
| HAdV | 49 | DQ393829 |
| HAdV | 50 | AY737798 |
| HAdV | 51 | JN226765 |
| HAdV | 52 | DQ923122 |
| HAdV | 53 | MK116618 |
| HAdV | 54 | AB448770 |
| HAdV | 55 | KC857701 |
| HAdV | 56 | HM770721 |
| HAdV | 57 | HQ003817 |
| HAdV | 58 | KF268319 |
| HAdV | 59 | JF799911 |
| HAdV | 60 | HQ007053 |
| HAdV | 61 | JF964962 |
| HAdV | 62 | JN162671 |
| HAdV | 63 | JN935766 |
| HAdV | 64 | EF121005 |
| HAdV | 65 | AP012285 |
| HAdV | 66 | JN860676 |
| HAdV | 67 | AP012302 |
| HAdV | 68 | JN860678 |
| HAdV | 69 | JN226748 |
| HAdV | 70 | KP641339 |
| HAdV | 71 | KF268207 |
| HAdV | HAdV-B PXHXFX | KF633445 |
| SimAdV | 6 | MA158592 |
| SimAdV | 16.1 | MF176115 |
| SimAdV | 18 | NC_022266 |
| SimAdV | 21 | BK000412 |
| SimAdV | 24 | AY530878 |
| SimAdV | 27.1 | FJ025909 |
| SimAdV | 27.2 | FJ025928 |
| SimAdV | 28.2 | FJ025915 |
| SimAdV | 29 | FJ025904 |
| SimAdV | 31.1 | FJ025906 |
| SimAdV | 31.2 | FJ025904 |
| SimAdV | 35.2 | FJ025910 |
| SimAdV | 41.1 | FJ025913 |
| SimAdV | 42.1 | FJ025903 |
| SimAdV | 42.2 | FJ025902 |
| SimAdV | 43 | FJ-25900 |
| SimAdV | 45 | FJ025901 |
| SimAdV | 46 | FJ025930 |
| SimAdV | 47 | FJ025929 |

The nucleotide and amino acid sequences are represented in the sequence listing filed herewith. For tentatively assigning the adenovirus isolates to the subgroup levels, the nucleotide sequences of the NHP_002, 005, 006, 007 008, and 012 isolates were aligned with a representative full genome nucleotide sequences of each of the human types HAdV-01 to HAdV-72 (downloaded from the NCBI Genbank database) using MAFFT software (version 7.427 for windows 64; downloaded from mafft.cbrc.jp/alignment/software/). From these data a phylogentic tree was constructed via the iTOL4 software (itol.embl.de/). The results demonstrate that the NHP_002, 005 and 008 sequence could be tentatively attributed to human adenovirus subgroup

58

Figure 4:
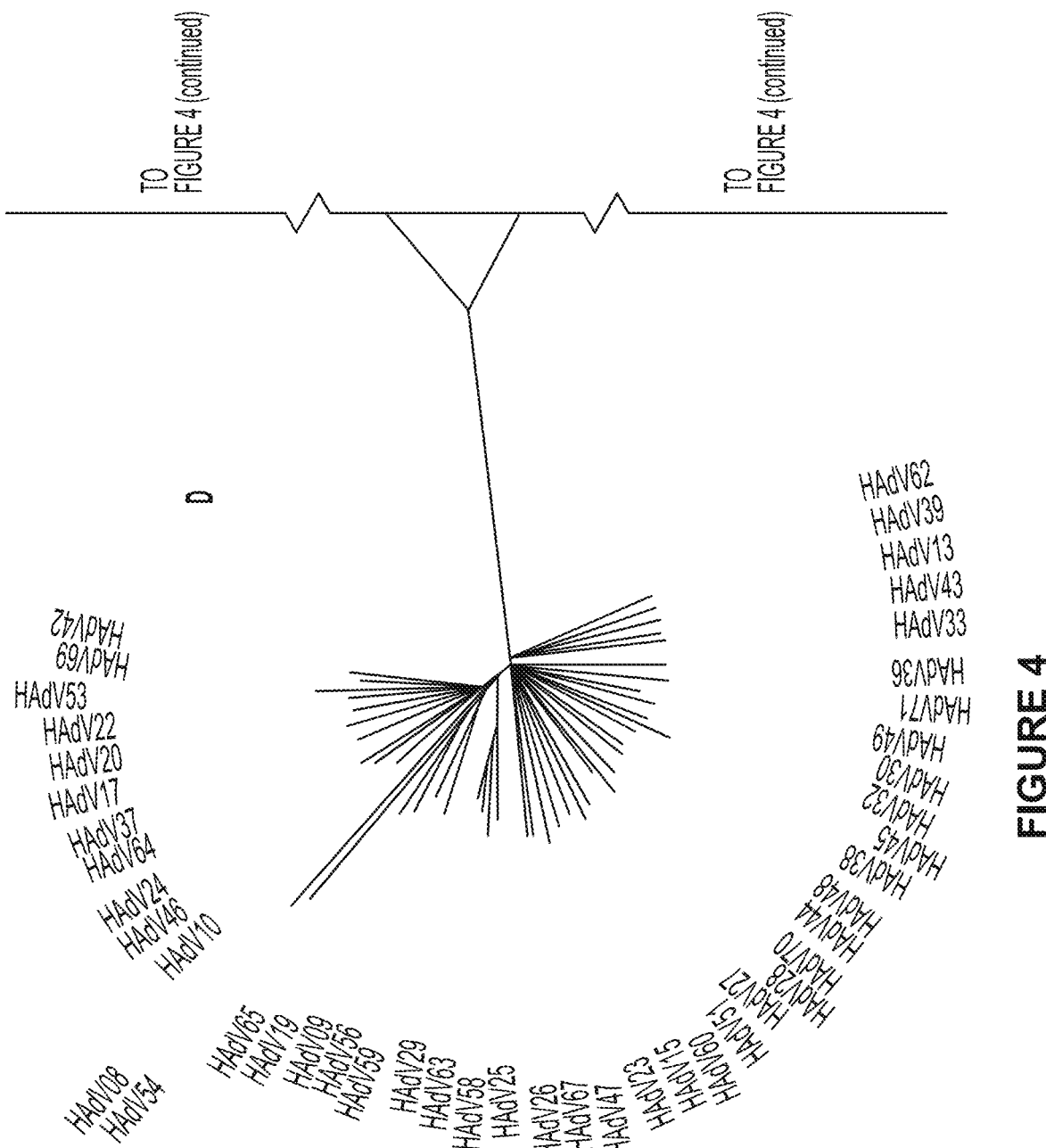
FIG. 4 shows a phylogenetic tree in which six of the NHP-AdV isolates have been indicated. The position of the newly isolated NHP adenoviruses are shown in an unrooted phylogram of the human adenoviruses of Sub-groups A-C and E-G.
Figure 4:
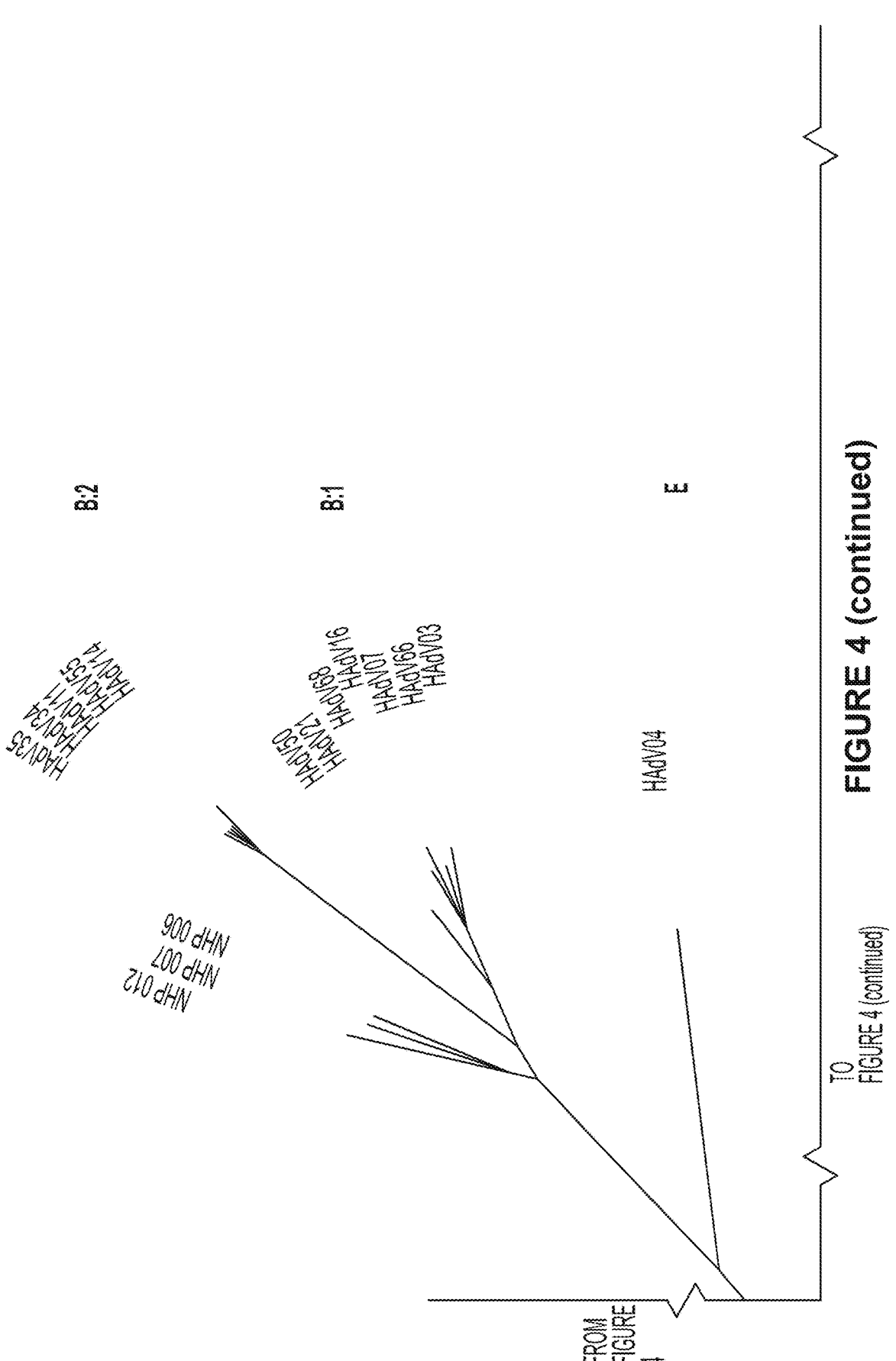
Figure 4:
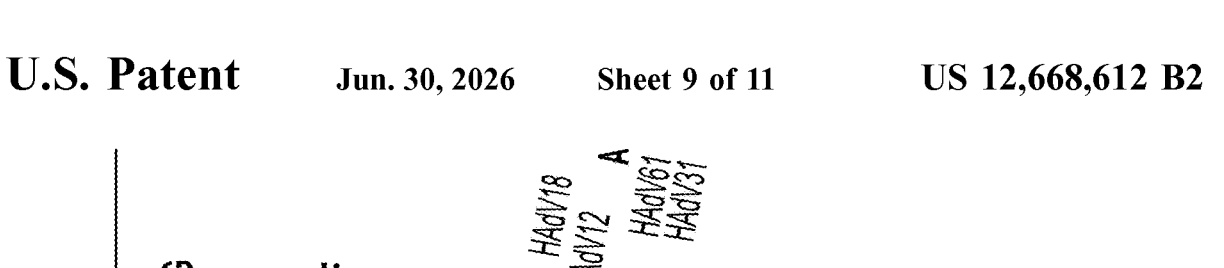

(formally species) HAdV-C, while the NHP_006, NHP_007 and NHP_012 should be placed in HAdV-B. The latter three viruses harbor 2 VA-RNA genes, and therefore could be tentatively attributed to the HAdV-B: 1 clade (FIGS. 2 and 4).

The Basic Local Alignment Search Tool (BLAST) at NCBI (blast.ncbi.nlm.nih.gov/Blast.cgi) was used for inspecting the amino-acid sequences of a number of proteins (i.e. hexon, fiber, penton base (III), protease, protein IX, the single stranded DNA binding protein (DBP), and polymerase) encoded by the genomes for the most similar sequences in the database.

For comparison of the similarity of the nucleotide sequences of the NHP_002, 005, 006, 007, 008 and 012 viruses and the most similar genomes in the Genbank database nucleotide BLAST searches were performed using the default parameters. The one or more similar genomes were aligned using the MAFFT software, and the aligned sequences were compared using Base-By-Base software obtained from the Viral Bioinformatic Resource Center (4virology.net/).

BLAST searches demonstrate that the NHP_005 genome is similar to the SimAdV43 and SimAdV45 genomes. Remarkably, the sequences were most dissimilar at the positions of gene III (encoding penton base), the hexon gene, the fiber gene and one of the E3 genes.

The NHP_002 genome is similar with SimAdV42.2 over its genome length with the exception of the hexon gene.

The NHP_008 genome is relatively similar to SimAdV43 over its genome length with the exception of the hexon gene, which is distinct The NHP_006 virus is similar to several simian adenoviruses, but appears to have fiber and E3 sequences that are distinct markedly from other adenoviruses in the Genbank database.

The NHP_007 virus most similar to the adenovirus SimAdV28.2 at the left hand sight of the genome up to the hexon region, while the right-hand side starting with the hexon gene and including the E3 region and the fiber is more similar to the SimAdV47 virus. This would be consistent with NHP_007 being the product of a natural recombination between SimAdV28.2 and SimAdV47-like adenoviruses.

The NHP_012 virus is most similar to the human adenovirus SimAdV35.2, from the left hand side of the genome up to the hexon gene. The hexon gene of NHP_012 is more similar to the SimAdV21 gene. The protease, the DBP and the 100K gene are highly similar to the SimAdV35.2 sequence, while the 22k, 33k and pVII genes and the E3 region are similar to the SimAdV27.2. The fiber and the right-hand side are similar to the SimAdV41.1 viruses. Taken together these data suggest that the simian adenoviruses are the products from natural recombination between adenovirus genomes.

The hexon, fiber, and penton base form the major capsid proteins and are known ligands for neutralizing antibodies. The E3 region encodes proteins involved in evasion of the cellular immune response. The dissimilarity is clear evidence that there is a selective pressure that drives the selection of escape mutants that changed penton-base, hexon, fiber, or E3. The fact that the penton-base, hexon, fiber, and E3 sequences are often markedly distinct from earlier described viruses suggest that the genes are occasionally exchanged between viruses during natural infections.

To restrict the replication of the NHP adenoviruses to tumor cells that have defects in the RB pathway the codons encoding the RB-binding element in the E1A proteins. In all of the adenoviruses the RB-binding domain of the E1A proteins can be readily identified on the basis of the sequence similarity of the RB-binding domain of the HAdV-5 (Table 6). The 24-codons encoding the 8 amino-acid long RB-binding domain can be deleted from plasmids encoding the E1A protein of the NHP adenoviruses.

To map the amino acids essential for pRB binding in the various E1A proteins, we aligned the amino-acids encoded by the first exon of the E1A gene of the NHP_002, 005, 006, 007, 008 and 012 viruses with the human adenovirus type 5 E1A amino acid sequence (cf. Avvakumov et al. (2004) Virology 329:477-492). In aligned sequences we located the regions homologous to the human adenovirus 5 sequence essential for RB binding 'LTCHEAGF' (Fueyo et al. (2000) Oncogene 19, 2-12). The codons for this region can be deleted by standard molecular biology techniques from plasmid clones of the NHP viruses.

TABLE 6

Sequence of the retinoblastoma-protein (RB) interacting elements in the adenovirus E1A proteins, their position and their amino-acid sequence

| Protein | position of 1st AA of element | RB-binding element |
|---|---|---|
| HAdV5 E1A exon 1 | 122 | LTCHEAGF |
| NHP_007 E1A exon 1 | 114 | LHCYEEGF |
| NHP_012 E1A exon 1 | 115 | LHCYEEGF |
| NHP_006 E1A exon 1 | 115 | LHCYEEGF |
| NHP_002 E1A exon 1 | 118 | LTCNESGF |
| NHP_005 E1A exon 1 | 112 | LTCHEPGF |
| NHP_003 E1A exon 1 | 119 | LTCNESGF |
| NHP_001 E1A exon 1 | 118 | LTCNESGF |
| NHP_008 E1A exon 1 | 111 | LTCHEPGF |

Stool samples used to isolate the viruses described herein. The stool samples were obtained via the veterinarians of Dutch zoo's that housed non-human primates living in captivity. Samples were obtained from Dutch zoo's in Rotterdam (Bly viruses), Hilvarenbeek (BB viruses), Arnhem (BZ viruses), and Apeldoorn (AH viruses) in July 2013, August 2013, September 2013, and November 2013, respectively.

TABLE 7

Bioinformatic annotation of NHP007 nucleic acid sequence

| Annotation NHP007 | start | stop | spliced? |
|---|---|---|---|
| Left ITR | 1 | 134 | N.A. |
| E1A | 572 | 1450 | Y |
| E1B 21K | 1618 | 2163 | N |
| E1B 55K | 1934 | 3410 | N |
| IX | 3503 | 3919 | N |
| IVA2 | 5606 | 3982 | Y |
| 52 K | 10921 | 12090 | N |
| pIIIa | 12115 | 13878 | N |
| pol | 13918 | 8459 | Y |
| pTP | 13918 | 5085 | Y |
| penton base | 13963 | 15717 | N |
| pVII | 15721 | 16299 | N |
| pV | 16342 | 17394 | N |
| pX | 17423 | 17650 | N |
| pVI | 17726 | 18478 | N |
| hexon | 18594 | 21470 | N |
| protease | 21501 | 22130 | N |
| DBP | 23783 | 22221 | N |
| 100K | 23814 | 26312 | N |
| 22K | 26005 | 26622 | N |
| 33K | 26005 | 26890 | Y |
| pVIII | 26960 | 27643 | N |
| E3-12.5K | 27643 | 27960 | N |

TABLE 7-continued

Bioinformatic annotation of NHP007 nucleic acid sequence

| Annotation NHP007 | start | stop | spliced? |
|---|---|---|---|
| E3-CR1α | 27914 | 28360 | N |
| E3-19K | 28345 | 28857 | N |
| E3-CR1β | 28884 | 29522 | N |
| E3-CR1γ | 29541 | 30296 | N |
| E3-RIDα | 30306 | 30581 | N |
| E3-RIDβ | 30586 | 30987 | N |
| E3-14.7 | 30980 | 31387 | N |
| fiber | 31620 | 32588 | N |
| E4-34K | 33789 | 32875 | N |
| E4-ORF6/7 | 33789 | 32627 | Y |
| E4-ORF4 | 34060 | 33677 | N |
| E4-ORF3 | 34423 | 34070 | N |
| E4-ORF2 | 34809 | 34420 | N |
| E4-ORF1 | 35225 | 34851 | N |
| Right-ITR | 35473 | 35605 | N.A. |

TABLE 8

Bioinformatic annotation of NHP0012 nucleic acid sequence

| annotation NHP012 | start | stop | spliced? |
|---|---|---|---|
| Left ITR | 1 | 114 | N.A. |
| E1A | 569 | 1448 | Y |
| E1B 21K | 1614 | 2159 | N |
| E1B 55K | 1919 | 3406 | N |
| IX | 3449 | 3915 | N |
| IVA2 | 3970 | 5594 | Y |
| 52K | 10892 | 12061 | N |
| pIIIa | 12089 | 13852 | N |
| pol | 13883 | 5073 | Y |
| pTP | 13883 | 8450 | Y |
| penton base | 13925 | 15616 | N |
| pVII | 15628 | 16206 | N |
| pV | 16426 | 17307 | N |
| pX | 17336 | 17566 | N |
| pVI | 17639 | 18361 | N |
| hexon | 18513 | 21380 | N |
| protease | 21408 | 22034 | N |
| DBP | 23663 | 22113 | N |
| 100K | 23694 | 26192 | N |
| 22K | 25888 | 26505 | N |
| 33K | 25888 | 26770 | Y |
| pVIII | 26840 | 27523 | N |
| E3-12.5K | 27523 | 27840 | N |
| E3CR1α | 27794 | 28240 | N |
| E3-19K | 28225 | 28737 | N |
| E3-CR1β | 28761 | 29294 | N |
| E3-CR1γ | 29316 | 29882 | N |
| E3-RIDα | 30302 | 30577 | N |
| E3-RIDβ | 30582 | 30986 | N |
| E3-14.7 | 30582 | 30986 | N |
| fiber | 31613 | 32578 | N |
| E4-ORF4 | 33668 | 34051 | N |
| E4-34K | 33780 | 32866 | N |
| E4-ORF6/7 | 33780 | 32618 | Y |
| E4-ORF3 | 34414 | 34061 | N |
| E4-ORF2 | 34800 | 34411 | N |
| E4-ORF1 | 35216 | 34842 | N |
| Right-ITR | 35484 | 35597 | N.A. |

TABLE 9

Bioinformatic annotation of NHP005 nucleic acid sequence

| annotation NHP005 | start | stop | spliced? |
|---|---|---|---|
| Left ITR | 1 | 63 | N.A. |
| E1A | 546 | 1459 | Y |
| E1B 21K | 1652 | 2206 | N |
| E1B 55K | 1957 | 3368 | N |

TABLE 9-continued

Bioinformatic annotation of NHP005 nucleic acid sequence

| annotation NHP005 | start | stop | spliced? |
|---|---|---|---|
| IX | 3559 | 3960 | N |
| IVA2 | 5551 | 4016 | Y |
| 52K | 10910 | 12136 | N |
| pIIIa | 12162 | 13949 | N |
| pol | 13318 | 5119 | Y |
| pTP | 13318 | 8499 | Y |
| penton base | 14018 | 15883 | N |
| pVII | 15912 | 16526 | N |
| pV | 16596 | 17675 | N |
| pX | 17704 | 17937 | N |
| pVI | 18035 | 18787 | N |
| hexon | 18891 | 21734 | N |
| protease | 21756 | 22388 | N |
| DBP | 24105 | 22474 | N |
| 100K | 24149 | 26635 | N |
| 22K | 26316 | 26635 | N |
| 33K | 26316 | 27225 | Y |
| pVIII | 27283 | 27966 | N |
| E3-12.5K | 27967 | 28290 | N |
| E3CR1α | 28800 | 28290 | N |
| E3-19K | 29015 | 29500 | N |
| E3-RIDα | 30777 | 31049 | N |
| E3-RIDβ | 31054 | 31482 | N |
| E3-14.7 | 31475 | 31861 | N |
| fiber | 32064 | 33809 | N |
| E4-ORF6/7 | 35156 | 33993 | Y |
| E4-34K | 35156 | 34272 | N |
| E4-ORF4 | 35421 | 35056 | N |
| E4-ORF3 | 35791 | 35438 | N |
| E4-ORF2 | 36180 | 35788 | N |
| E4-ORF1 | 36215 | 36598 | N |
| Right-ITR | 36969 | 37034 | N.A. |

Table 10

Bioinformatic annotation of NHP002 nucleic acid sequence

| annotation NHP002 | start | stop | spliced? |
|---|---|---|---|
| Left ITR | 1 | 109 | N.A. |
| E1A | 561 | 1513 | Y |
| E1B 21K | 1682 | 2248 | N |
| E1B 55K | 1987 | 3513 | N |
| IX | 3610 | 4053 | N |
| IVA2 | 5736 | 4112 | Y |
| 52K | 11094 | 12356 | N |
| pIIIa | 12380 | 14152 | N |
| pol | 14212 | 5218 | Y |
| pTP | 14212 | 8622 | Y |
| penton base | 14254 | 16008 | N |
| pVII | 16011 | 17819 | N |
| pV | 16701 | 17819 | N |
| pX | 17844 | 18086 | N |
| pVI | 18191 | 18970 | N |
| hexon | 19098 | 21965 | N |
| protease | 21995 | 22630 | N |
| DBP | 24388 | 22751 | N |
| 100K | 24438 | 26855 | N |
| 22K | 26551 | 27174 | N |
| 33K | 26551 | 27491 | Y |
| pVIII | 27566 | 28249 | N |
| E3-12.5K | 28250 | 28567 | N |
| E3CR1α | 29059 | 29265 | N |
| E3-19K | 29262 | 29741 | N |
| E3-CR1βγ | 29770 | 30672 | N |
| E3-RIDα | 30669 | 31484 | N |
| E33 11.6 | 30960 | 31484 | N |
| E3-RIDβ | 31771 | 32172 | N |
| fiber | 32757 | 34490 | N |
| E4-34K | 35733 | 34949 | N |
| E4-ORF6/7 | 35833 | 34673 | Y |
| E4-ORF4 | 36098 | 35733 | N |
| E4-ORF3 | 36455 | 36108 | N |

Table 10-continued

Bioinformatic annotation of NHP002 nucleic acid sequence

| annotation NHP002 | start | stop | spliced? |
|---|---|---|---|
| E4-ORFB | 36844 | 36452 | N |
| E4-ORF1 | 37289 | 36903 | N |
| Right-ITR | 37596 | 37704 | N.A. |

TABLE 11

Bioinformatic annotation of NHP006 nucleic acid sequence

| annotation NHP006 | start | stop | spliced orf |
|---|---|---|---|
| Left ITR | 1 | 132 | n.a. |
| E1A | 576 | 1454 | Y |
| E1B 21K | 1622 | 2167 | N |
| E1B 55K | 1927 | 3414 | N |
| IX | 3506 | 3919 | N |
| IVA2 | 3985 | 5031 | Y |
| 52K | 10923 | 12092 | N |
| pIIIa | 12117 | 13877 | N |
| pol | 13921 | 5088 | Y |
| pTP | 13921 | 8459 | Y |
| penton base | 13966 | 15708 | N |
| pVII | 15713 | 16291 | N |
| pV | 16334 | 17386 | N |
| pX | 17415 | 17642 | N |
| pVI | 17716 | 18468 | N |
| hexon | 18584 | 21454 | N |
| protease | 21485 | 22114 | N |
| DBP | 23765 | 22203 | N |
| 100K | 23796 | 26291 | N |
| 22K | 25987 | 26604 | N |
| 33K | 25987 | 26872 | Y |
| pVIII | 26942 | 27625 | N |
| E3-12.5K | 27625 | 27942 | N |
| E3CR1α | 27896 | 28342 | N |
| E3-19K | 28327 | 28845 | N |
| E3-CR1γ | 28867 | 29496 | N |
| E3-6.6K | 29507 | 29854 | N |
| E3-RIDα | 29893 | 30168 | N |
| E3-RIDβ | 30137 | 30568 | N |
| E3-14.7 | 30561 | 30968 | N |
| fiber | 31200 | 32162 | N |
| E4-34K | 33364 | 32450 | N |
| E4-ORF6/7 | 33364 | 32202 | Y |
| E4-ORF4 | 33635 | 33252 | N |
| E4-ORF3 | 33998 | 33645 | N |
| E4-ORF2 | 34384 | 33995 | N |
| E4-ORF1 | 34800 | 34426 | N |
| Right-ITR | 35048 | 35179 | n.a. |

TABLE 12

Bioinformatic annotation of NHP008 nucleic acid sequence

| annotation NHP008 | start | stop | spliced ORF |
|---|---|---|---|
| Left ITR | 1 | 73 | N.A. |
| E1A | 546 | 1459 | Y |
| E1B 21K | 1657 | 2214 | N |
| E1B 55K | 1962 | 3476 | N |
| IX | 3567 | 3968 | N |
| IVA2 | 5559 | 4024 | Y |
| 52K | 10915 | 12141 | N |
| pIIIa | 12167 | 13951 | N |
| pol | 13323 | 5127 | Y |
| pTP | 13323 | 8507 | Y |
| penton base | 14021 | 15991 | N |
| pVII | 16020 | 16628 | N |
| pV | 16698 | 15991 | N |
| pX | 17800 | 18033 | N |
| pVI | 18131 | 18883 | N |

63

TABLE 12-continued

Bioinformatic annotation of NHP008 nucleic acid sequence

| annotation NHP008 | start | stop | spliced ORF |
|---|---|---|---|
| hexon | 18987 | 21866 | N |
| protease | 21888 | 22520 | N |
| DBP | 24258 | 22612 | N |
| 100K | 24302 | 26812 | N |
| 22K | 26493 | 27092 | N |
| 33K | 26493 | 27402 | Y |
| pVIII | 27460 | 28143 | N |
| E3-12.5K | 28144 | 28467 | N |
| E3-19K | 29191 | 29676 | N |
| E3-CR1β | 29721 | 30140 | N |
| E3-RIDα | 30953 | 31225 | N |
| E3-RIDβ | 31230 | 31658 | N |
| E3-14.7 | 31651 | 32037 | N |
| fiber | 32243 | 33985 | N |
| E4-ORF6 | 35332 | 34448 | N |
| E4-ORF6/7 | 35332 | 34169 | Y |
| E4-ORF4 | 35597 | 35232 | N |
| E4-ORF3 | 35967 | 35614 | N |
| E4-ORF2 | 36356 | 35964 | N |
| E4-ORF1 | 36774 | 36391 | N |
| Right-ITR | 37128 | 37200 | N.A. |

Generation of the NHP-007 Vector

To generate a plasmid clone of the NHP-007 virus a synthetic double-stranded DNA fragment was synthesized that encompassed the left-hand side NHP-007 nucleotides 1-513 and right-hand side nucleotides 34914-35606. These elements were separated by the sequence 5'-gatatcgaggttaac-3' (SEQ ID NO: 217) to provide EcoRV and HpaI restriction sites. The entire fragment was flanked by the sequence 5'-acgcgtatttaaat-3' (SEQ ID NO: 218) to generate unique MluI and SwaI restriction sites. The fragment was inserted into the low-copy number plasmid pACNR1181 (Bredenbeek, P J et al 2003) to generate plasmids pACNR1181-adapter1 oriA.

Figure 5:
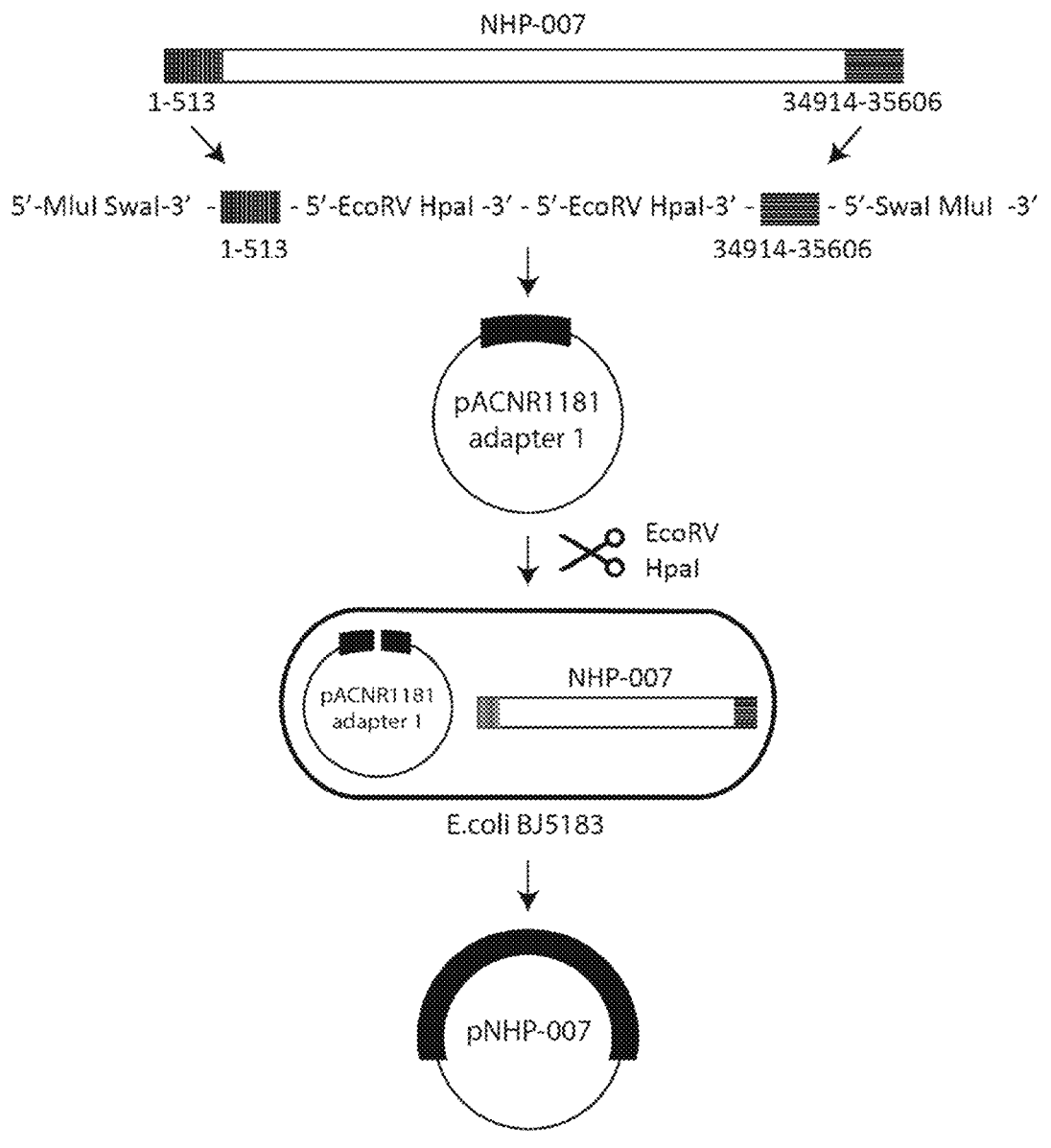
FIG. 5 shows a schematic overview of the generation of the vector plasmid NHP-007 (pNHP-007).

To generate a plasmid clone containing the entire NHP-007 DNA genome, the NHP-007 genomic DNA was isolated from NHP-007-infected HER911 cells by a modified HIRT-extraction protocol. In this protocol a protease treatment step was introduced to remove the covalently linked terminal protein before extraction of the DNA. The NHP-007 DNA and HpaI-EcoRV-digested pACNR1181-adapter1 oriA plasmid DNA in an 1:1 molecular ratio were introduced into E. coli bacterial cells (Hanahan, D 1983, Kong, Y et al 1999) by electroporation. The plasmid can only be recreated by homologous recombination of the NHP-007 DNA with the EcoRV and HpaI linearized plasmid DNA (FIG. 5). Colonies that arose after Ampicillin selection were screened for the anticipated restriction pattern. A clone with the expected restriction pattern was expanded and further characterized by restriction analyses. Plasmid colony pNHP-007_clone 2 was selected for further study (hereafter named pNHP-007).

Figure 6:
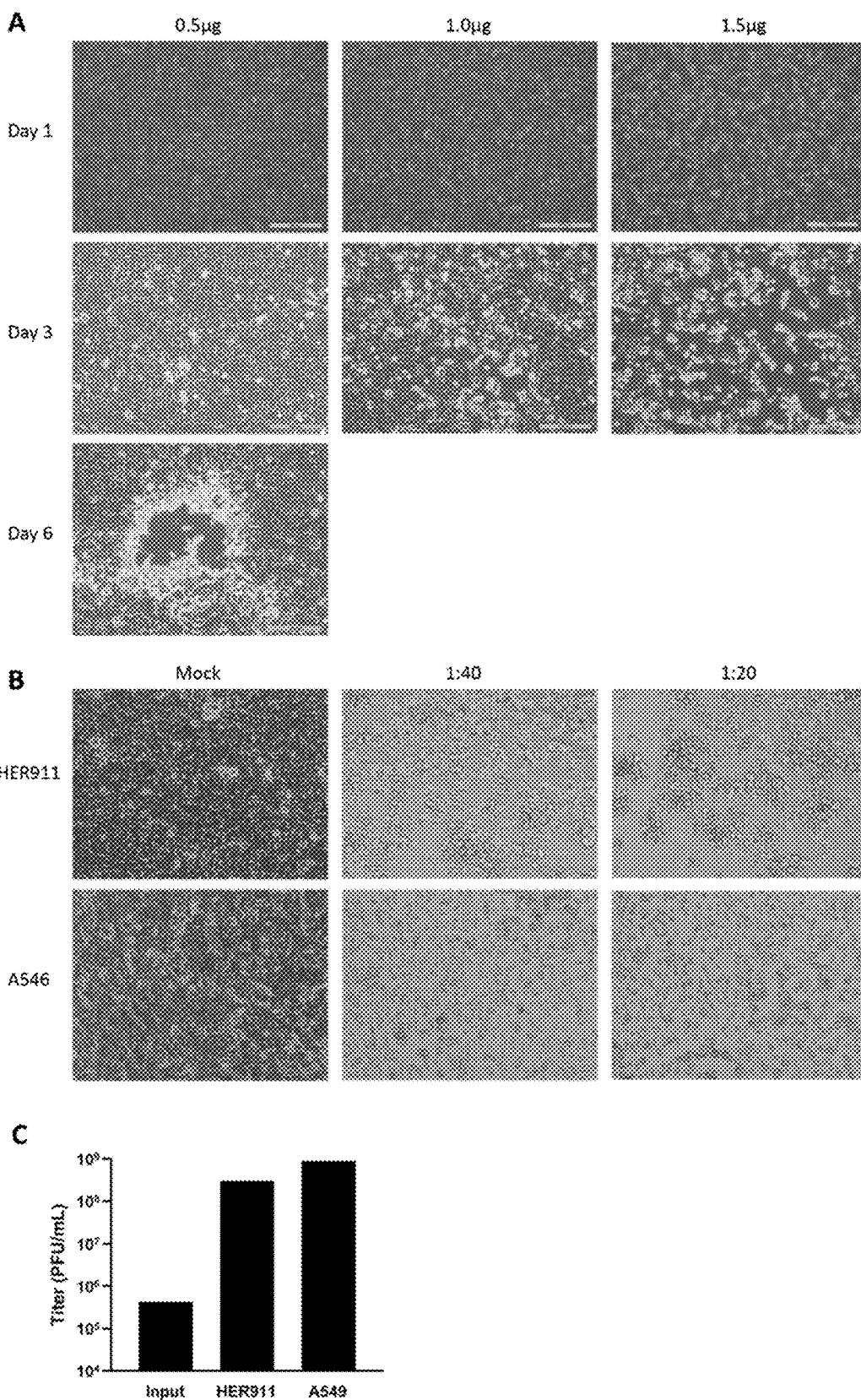
FIG. 6 shows the NHP-007 vector plasmid is infectious when transferred into cells and that it contains all element necessary for the infections replication cycle and that the resulting virus retains its lytic activity in human cells. A) HER911 were transfected with 0.5-1.5 μg of the NHP-007 plasmid. Pictures were taken 1, 3, and 6 dpi. B) The supernatant containing the newly formed NHP-007 virions was passed through a 0.45 μm filter and a 1:40 or 1:20 dilution of the supernatant was added to a culture of HER911 and A549 cells. Pictures were taken at 24 hpi. C) After 48 hours, supernatant from the HER911 and A549 cell cultures was collected (1:40 only) and freeze/thawed for three cycles. Titer was determined plaque assay at 7 dpi.

To test the viability of the cloned vector, HER911 cells were transfected with the NHP-007 plasmid at different concentrations and cells were checked for sign of cytopathic effect (CPE) daily (FIG. 6A). Starting at three days post infection (dpi), a dose-dependent presence of CPE could be observed in the cell cultures. In the lowest concentration, a phenotypic plaque had formed by 6 dpi, illustrative of viral spread. In order to validate that the observed effects were of viral origin, the supernatant was collected at 6 dpi and freeze/thawed for one cycle before passing it through a 0.45 µm filter, after which it was added to a fresh culture of HER911 cells. The HER911 cell line is a helper cell line established for the production of early region 1-deleted adenoviral vectors, and expresses the early 1 (E1) region of human adenovirus type 5 (HAdV-05) (Fallaux, F J et al 1996). The expression of HAdV-05 E1 in HER911 could substitute for a non-functional E1 in the NHP-007 vector. Therefore, cultures of A549 cells, which do not express E1, were exposed to the filtrate as well (FIG. 6B). At 24 hours post infection (hpi), all cultures demonstrated complete CPE, thus confirming the presence of infectious virus particles. No differences were observed in the replication potential of the NHP-007 vector in HER911 and A549 cells (FIG. 6C).

Generation of the Δ24-Deletion in pNHP-007

A 24 bp-deletion in the Retinoblastoma (Rb)-binding domain of the E1A gene has been shown to generate a mutant adenovirus with selective replication in tumor cells (Stolarek, R et al 2004). To create a Δ24-adenovirus mutant of pNHP-007, a ClaI-deletion mutant plasmid was created which encompassed the entire E1 region and part of E2. The 24 bp-deletion was generated in the ClaI-deletion mutant by in vivo assembly (IVA) cloning (García-Nafría, J et al 2016). The mutant plasmid was again introduced in E. coli, as described previously. Colonies that arose after Ampicillin selection were screened for the anticipated restriction pattern. Two clones with the expected restriction pattern were expanded and sequenced to validate the deletion.

Method to Test Viability of pNHP-007

Transfection One day prior to transfection, a 6-well plate was seeded with HER911 cells in DMEM supplemented with 8% foetal calf serum (FCS) and pen/strep (DMEM$_{COMP}$), and grown confluent overnight (o/n). The NHP-007 plasmid was diluted in OptiMEM using 0.5-1.5 µg plasmid in a total volume of 100 µL. Likewise, 3 µL polyethylenimine (PEI, 1.0 mg/mL) per µg DNA was diluted in 100 µL OptiMEM and both dilutions were mixed 1:1 by pipetting. The medium of the HER911 cells was replaced by 1 mL of DMEM supplemented with 2% FCS and pen/strep (DMEM$_{LOW}$) and the mixtures were added to the wells. Cells were incubated at 37° C./5% CO$_2$ o/n. The next morning, medium was replaced by DMEM$_{LOW}$ and cells were cultured for another 5 days. Pictures were taken by microscopy at 1, 3, and 6 dpi.

Filtration One day prior to infection, HER911 and A549 cells were seeded in a 24-well plate at 10$^5$ cells/well in DMEM$_{COMP}$ and incubated o/n. Supernatant was collected from the cultures exposed to 1.0 µg plasmid at 6 dpi and freeze/thawed for one cycle. Next, the supernatant was passed through a 0.45 µm Acrodisc© Syringe filter (PALL Life Sciences, PN4148). Medium from the HER911 and A549 cultures was replaced by DMEM$_{LOW}$ and the filtrate was directly added to at a 1:20 and 1:40 dilution. Pictures were taken by microscopy at 24 hpi.

Titration At 48 hpi, supernatant was collected from cells exposed to 1:40 of the filtrate. As a control, the filtrate was diluted 1:40 in DMEM$_{LOW}$. All samples were freeze/thawed for three cycles and spun down for 5 min at 3000 rpm to remove cell debris. Titers were determined by plaque assay.

The reader's attention is directed to all papers and documents which are filed concurrently with or previous to this specification in connection with this application and which are open to public inspection with this specification, and the contents of all such papers and documents are incorporated herein by reference.

All of the features disclosed in this specification (including any accompanying claims, abstract and drawings), and/or all of the steps of any method or process so disclosed, may be combined in any combination, except combinations where at least some of such features and/or steps are mutually exclusive.

Each feature disclosed in this specification (including any accompanying claims, abstract and drawings), may be replaced by alternative features serving the same, equivalent, or similar purpose, unless expressly stated otherwise. Thus, unless expressly stated otherwise, each feature disclosed is one example only of a generic series of equivalent or similar features.

The invention is not restricted to the details of any foregoing embodiments. The invention extends to any novel one, or any novel combination, of the features disclosed in this specification (including any accompanying claims, abstract and drawings), or to any novel one, or any novel combination, of the steps of any method or process so disclosed.

REFERENCES

Arnberg, N., Pring-Akerblom, P., & Wadell, G. (2002). Adenovirus Type 37 Uses Sialic Acid as a Cellular Receptor on Chang C Cells. *Journal of Virology*, 76(17), 8834-8841. doi.org/10.1128/jvi.76.17.8834-8841.2002

Arnberg, Niklas. (2015). Adenovirus receptors: implications for tropism, treatment and targeting. *Reviews in Medical Virology*, 25(1), 2-23. doi.org/10.1002/rmv Barnadas, C., Schmidt, D. J., Fischer, T. K., & Fonager, J. (2018). Molecular epidemiology of human adenovirus infections in Denmark, 2011-2016. *Journal of Clinical Virology*, 104(January), 16-22. doi.org/10.1016/j.jcv.2018.04.012

Bauer, U., Flunker, G., Bruss, K., Kallwellis, K., Liebermann, H., Luettich, T., . . . Seidel, W. (2005). Detection of antibodies against adenovirus protein IX, fiber, and hexon in human sera by immunoblot assay. *Journal of Clinical Microbiology*, 43(9), 4426-4433. doi.org/10.1128/JCM.43.9.4426-4433.2005

Berk, A. J. (2007) Adenoviridae: the viruses and their replication, in Fields virology (editors-in-chief, David M. Knipe, Peter M. Howley) Lippincott Williams and Wilkins, Philadelphia, PA, USA)

Wold W. S. M. & Horwitz, M. S. (2007) Adenoviruses. In Fields virology (editors-in-chief, David M. Knipe, Peter M. Howley) Lippincott Williams and Wilkins, Philadelphia, PA, USA)

Cappuccini, F., Stribbling, S., Pollock, E., Hill, A. V. S., & Redchenko, I. (2016). Immunogenicity and efficacy of the novel cancer vaccine based on simian adenovirus and MVA vectors alone and in combination with PD-1 mAb in a mouse model of prostate cancer. *Cancer Immunology, Immunotherapy*, 65(6), 701-713. doi.org/10.1007/s00262-016-1831-8

Cervera-Carrascon, V., Siurala, M., Santos, J. M., Havunen, R., Tähtinen, S., Karell, P., . . . Hemminki, A. (2018). TNFa and IL-2 armed adenoviruses enable complete responses by anti-PD-1 checkpoint blockade. *OncoImmunology*, 7(5), 1-11. doi.org/10.1080/2162402X.2017.1412902

Cheng, T., Song, Y., Zhang, Y., Zhang, C., Yin, J., Chi, Y., & Zhou, D. (2017). *A novel oncolytic adenovirus based on simian adenovirus.* 8(16), 26871-26885.

Engeland, C. E., Grossardt, C., Veinalde, R., Bossow, S., Lutz, D., Kaufmann, J. K., . . . Ungerechts, G. (2014). CTLA-4 and PD-L1 checkpoint blockade enhances oncolytic measles virus therapy. *Molecular Therapy*, 22(11), 1949-1959. doi.org/10.1038/mt.2014.160

Filley, A. C., & Dey, M. (2017). Immune System, Friend or Foe of Oncolytic Virotherapy? *Frontiers in Oncology*, 7(May), 1-8. doi.org/10.3389/fonc.2017.00106

Gaggar, A., Shayakhmetov, D. M., & Lieber, A. (2003). CD46 is a cellular receptor for group B adenoviruses. *Nature Medicine*, 9(11), 1408-1412. doi.org/10.1038/nm952

Grekova, S. P., Raykov, Z., Zawatzky, R., Rommelaere, J., & Koch, U. (2012). Activation of a glioma-specific immune response by oncolytic parvovirus Minute Virus of Mice infection. *Cancer Gene Therapy*, 19(7), 468-475. doi.org/10.1038/cgt.2012.20

Grossardt, C., Engeland, C. E., Bossow, S., Halama, N., Zaoui, K., Leber, M. F., . . . Ungerechts, G. (2013). Granulocyte-Macrophage Colony-Stimulating Factor-Armed Oncolytic Measles Virus Is an Effective Therapeutic Cancer Vaccine. *Human Gene Therapy*, 24(7), 644-654. doi.org/10.1089/hum.2012.205

Heise, C., Sampson-Johannes, A., Williams, A., McCormick, F., Von Hoff, D. D., & Kirn, D. H. (1997). ONYX-015, an EIB gene-attenuated adenovirus, causes tumor-specific cytolysis and antitumoral efficacy that can be augmented by standard chemotherapeutic agents. *Nature Medicine*, (44), 398-399. Retrieved from http://ci.ni-i.ac.jp/naid/110002916101/

Hoppe, E., Pauly, M., Gillespie, T. R., Akoua-Koffi, C., Hohmann, G., Fruth, B., . . . Calvignac-Spencer, S. (2015). Multiple cross-species transmission events of human adenoviruses (HAdV) during hominine evolution. *Molecular Biology and Evolution*, 32(8), 2072-2084. doi.org/10.1093/molbev/msv090

Kaufman, H. L., Kohlhapp, F. J., & Zloza, A. (2015). Oncolytic viruses: A new class of immunotherapy drugs. *Nature Reviews Drug Discovery*, 14(9), 642-662. doi.org/10.1038/nrd4663

Kleijn, A., Kloezeman, J., Treffers-Westerlaken, E., Fulci, G., Leenstra, S., Dirven, C., . . . Lamfers, M. (2014). The in vivo therapeutic efficacy of the oncolytic adenovirus Delta24-RGD is mediated by tumor-specific immunity. *PLOS ONE*, 9(5). doi.org/10.1371/journal.pone.0097495

Larson, C., Oronsky, B., Scicinski, J., Fanger, G. R., Stirn, M., Oronsky, A., & Reid, T. R. (2015). Going viral: a review of replication-selective oncolytic adenoviruses. *Oncotarget*, 6(24). doi.org/10.18632/oncotarget.5116

Lion, T. (2014). Adenovirus infections in immunocompetent and immunocompromised patients. *Clinical Microbiology Reviews*, 27(3), 441-462. doi.org/10.1128/CMR.00116-13

Lynch, J. P., & Kajon, A. E. (2016). Adenovirus: Epidemiology, Global Spread of Novel Serotypes, and Advances in Treatment and Prevention. *Seminars in Respiratory and Critical Care Medicine*, 37(4), 586-602. doi.org/10.1055/s-0036-1584923

Madisch, I., Hofmayer, S., Moritz, C., Grintzalis, A., Hainmueller, J., Pring-Akerblom, P., & Heim, A. (2007). Phylogenetic Analysis and Structural Predictions of Human Adenovirus Penton Proteins as a Basis for Tissue-Specific Adenovirus Vector Design. *Journal of Virology*, 81(15), 8270-8281. doi.org/10.1128/jvi.00048-07

Martin, N. T., Roy, D. G., Workenhe, S. T., Den, D. J. M. Van, Hoeben, R. C., Mossman, K. L., & Bell, J. C. (2019). Pre-surgical neoadjuvant oncolytic virotherapy confers protection against rechallenge in a murine model of breast cancer. *Scientific Reports*, (October 2018), 3-8. doi.org/10.1038/s41598-018-38385-7

Mostafa, A. A., Meyers, D. E., Thirukkumaran, C. M., Liu, P. J., Gratton, K., Spurrell, J., . . . Morris, D. G. (2018).

Oncolytic reovirus and immune checkpoint inhibition as a novel immunotherapeutic strategy for breast cancer. *Cancers,* 10(6), 1-18. doi.org/10.3390/cancers10060205

Panto, L., Podgorski, I. I., Jánoska, M., Marko, O., & Harrach, B. (2015). Taxonomy proposal for Old World monkey adenoviruses: characterisation of several non-human, non-ape primate adenovirus lineages. *Archives of Virology,* 160(12), 3165-3177. doi.org/10.1007/s00705-015-2575-z Raja, J., Ludwig, J. M., Gettinger, S. N., Schalper, K. A., & Kim, H. S. (2018). Oncolytic virus immunotherapy: future prospects for oncology. *Journal for Immuno-Therapy of Cancer,* 6(1), 140. doi.org/10.1186/s40425-018-0458-z Roy, S., Vandenberghe, L. H., Kryazhimskiy, S., Grant, R., Calcedo, R., Keough, M., . . . Wilson, J. M. (2009). *Isolation and Characterization of Adenoviruses Persistently Shed from the Gastrointestinal Tract of Non-Human Primates.* 5(7), 1-9. doi.org/10.1371/journal.ppat.1000503

Shashkova, E. V., May, S. M., & Barry, and M. A. (2010). *Characterization of human adenovirus serotypes 5, 6, 11, and 35 as anticancer agents.* 46(2), 220-231. doi.org/10.1016/j.freeradbiomed.2008.10.025. The Short, J. J., Vasu, C., Holterman, M. J., Curiel, D. T., & Pereboev, A. (2006). Members of adenovirus species B utilize CD80 and CD86 as cellular attachment receptors. *Virus Research,* 122(1-2), 144-153. doi.org/10.1016/j.virusres.2006.07.009

Shtrichman, R., & Kleinberger, T. (1998). Adenovirus Type 5 E4 Open Reading Frame 4 Protein Induces Apoptosis in Transformed Cells Adenovirus Type 5 E4 Open Reading Frame 4 Protein Induces Apoptosis in Transformed Cells. *Journal of Virology,* 72(4), 2975.

Vogels, R., Zuijdgeest, D., van Rijnsoever, R., Hartkoorn, E., Damen, I., de Bethune, M.-P., . . . Havenga, M. (2003). Replication-Deficient Human Adenovirus Type 35 Vectors for Gene Transfer and Vaccination: Efficient Human Cell Infection and Bypass of Preexisting Adenovirus Immunity. *Journal of Virology,* 77(15), 8263-8271. doi.org/10.1128/jvi.77.15.8263-8271.2003

Wang, H., Li, Z., Liu, Y., Persson, J., Beyer, I., Möller, T., . . . Lieber, A. (2011). Desmoglein 2 is a receptor for adenovirus serotypes 3, 7, 11, and 14. *Nature Medicine,* 17(1), 96-104. doi.org/10.1038/nm.2270.Desmoglein Zhang, Y., & Bergelson, J. M. (2005). *Adenovirus Receptors.* 79(19), 12125-12131. doi.org/10.1128/JVI.79.19.12125

Zhao, H., Xu, C., Luo, X., Wei, F., Wang, N., Shi, H., & Ren, X. (2018). Seroprevalence of neutralizing antibodies against human adenovirus type-5 and chimpanzee adenovirus type-68 in cancer patients. *Frontiers in Immunology,* 9 (MAR), 1-9. doi.org/10.3389/fimmu.2018.00335

Thomas M A, Spencer J F, Toth K, Sagartz J E, Phillips N, Wold W S M. Immunosuppression enhances oncolytic adenovirus replication and anti tumor efficacy in the Syrian hamster model. Mol Ther. 2008; 16:1665-1673

Bredenbeek P J, Kooi E A, Lindenbach B, Huijkman N, Rice C M, Spaan W J M (2003). A stable full-length yellow fever virus cDNA clone and the role of conserved RNA elements in flavivirus replication. J Gen Virol, 84, 1261-1268. doi:10.1099/vir.0.18860-0.

Hanahan D. Studies on transformation of *Escherichia coli* with plasmids (1983). *J Mol Biol,* 166(4), 557-580. doi: 10.1016/50022-2836(83)80284-8

Kong Y, Yang T, Geller A I (1999). An efficient in vivo recombination cloning procedure for modifying and combining HSV-1 cosmids. *J Virol Methods,* 80(2), 129-136. doi:10.1016/50166-0934(99)00033-6

Fallaux F J, Kranenburg O, Cramer S J, et al. (1996) Characterization of 911: a new helper cell line for the titration and propagation of early region 1-deleted adeno-viral vectors. *Hum Gene Ther,* 7(2).215-222. do': 10, 1089/hum, 1996.7.2-215

Stolarek, R., Gomez-Manzano, C., Jiang, H. et al. (2004). Robust infectivity and replication of Delta-24 adenovirus induce cell death in human medulloblastoma. *Cancer Gene Ther,* 11, 713-720. doi.org/10.1038/sj.cgt.7700731

García-Nafría, J., Watson, J. F., & Greger, I. H. (2016). Iva Cloning: A Single-Tube Universal Cloning System Exploiting Bacterial in Vivo Assembly. *Sci Rep,* 6, 27459. doi.org/10.1038/srep27459

Whyte, P., Ruley, H. E., and Harlow, E (1988). Two regions of the adenovirus early region 1A proteins are required for transformation. J. Virol. 62, 257-265.

Whyte, P., Williamson, N. M., Harlow, E. (1989) Cellular Targets for Transformation by the Adenovirus E1A Proteins. Cell 56:67-75.

TABLE 13

| SEQ ID NO concordance table for NHP 007, NHP 012 and NHP 006 | | |
| --- | --- | --- |
| SEQ ID NOs FOR NHP 007 (also known as Ape adenovirus AH34 herein)- isolated from Gorilla | SEQ ID NOs FOR NHP 012 (also known as Ape adenovirus BZ34 herein)- isolated from Bonobo | SEQ ID NOs FOR NHP 006 (also known as Ape adenovirus AH29 herein)- isolated from Gorilla |
| Nucleotide Full length virus | | |
| 1 | 36 | 71 |
| Protein E3 CR1-beta | | |
| 2 | 47 | N/A |
| Protein 100K | | |
| 3 | 37 | 73 |
| Protein 22K | | |
| 4 | 38 | 74 |
| Protein 33K | | |
| 5 | 39 | 75 |
| Protein 52K | | |
| 6 | 40 | 76 |
| Protein DBP | | |
| 7 | 41 | 77 |
| Protein E1B 19K | | |
| 8 | 42 | 78 |
| Protein E1B 55K | | |
| 9 | 43 | 79 |
| Protein E3 12.5K | | |
| 10 | 44 | 80 |
| Protein E3 14.7K | | |
| 11 | 45 | 81 |
| Protein E3 CR1-alpha | | |
| 12 | 46 | 82 |
| Protein E3 CR1-gamma | | |
| 13 | 48 | 83 |
| Protein E3 gp19K | | |
| 14 | 49 | 84 |
| Protein E4 ORF1 | | |
| 15 | 52 | 85 |
| Protein E3 RID-alpha | | |
| 16 | 50 | 86 |
| Protein E3 RID-beta | | |
| 17 | 69 | 87 |
| Protein E4 34K/ E4ORF6 | | |
| 18 | 51 | 88 |
| Protein E4 ORF2 | | |
| 19 | 53 | 89 |
| Protein E4 ORF3 | | |
| 20 | 54 | 90 |
| Protein E4 ORF4 | | |
| 21 | 55 | 91 |
| Protein fiber | | |
| 22 | 56 | 92 |
| Protein hexon | | |
| 23 | 57 | 93 |
| Protein IVa2 | | |
| 24 | 58 | 94 |
| Protein IX | | |
| 25 | 59 | 95 |
| Protein penton base | | |
| 26 | 60 | 96 |
| Protein pIIIa | | |
| 27 | 61 | 97 |
| Protein pol | | |
| 28 | 62 | 98 |
| Protein protease | | |
| 29 | 63 | 99 |
| Protein pTP | | |
| 30 | 64 | 100 |
| Protein pVI | | |
| 31 | 65 | 101 |
| Protein pVII | | |
| 32 | 66 | 102 |
| Protein pVIII | | |
| 33 | 67 | 103 |
| Protein pX | | |
| 34 | 68 | 104 |
| Protein V | | |
| 35 | 70 | 105 |

TABLE 13-continued

SEQ ID NO concordance table for NHP 007, NHP 012 and NHP 006

|  | SEQ ID NOs FOR NHP 007 (also known as Ape adenovirus AH34 herein)- isolated from Gorilla | SEQ ID NOs FOR NHP 012 (also known as Ape adenovirus BZ34 herein)- isolated from Bonobo | SEQ ID NOs FOR NHP 006 (also known as Ape adenovirus AH29 herein)- isolated from Gorilla |
|---|---|---|---|
| Protein E1A 13S | 211 | 213 | 210 |
| Protein E3 6.6 kDa |  |  | 214 |

TABLE 14

SEQ ID NO concordance table for NHP 002, NHP 005 and NHP 008

|  | SEQ ID NOs FOR NHP 002 (also known as ape adenovirus AH6 herein)- isolated from Bonobo | SEQ ID NOs FOR NHP 005 (also known as ape adenovirus AH16 herein)- Isolated from Urangutan | SEQ ID NOs FOR NHP 008 (also known as Ape adenovirus AH35 herein)- isolated from Gorilla |
|---|---|---|---|
| Nucleotide Full length virus | 106 | 142 | 176 |
| Protein 100K | 107 | 143 | 177 |
| Protein 13.6 kD protein | 108 | 144 | 178 |
| Protein 22K | 109 | 145 | 179 |
| Protein 33K | 110 | 146 | 180 |
| Protein 52K | 111 | 147 | 181 |
| Protein DBP | 112 | 148 | 182 |
| Protein E1B 19K | 113 | 149 | 183 |
| Protein E1B 55K | 114 | 150 | 184 |
| Protein E3 11.6kD | 115 | N/A | N/A |
| Protein E3 12.5K | 116 | 151 | 185 |
| Protein E3 14.7K | 117 | 152 | 186 |

TABLE 14-continued

SEQ ID NO concordance table for NHP 002, NHP 005 and NHP 008

|  | SEQ ID NOs FOR NHP 002 (also known as ape adenovirus AH6 herein)- isolated from Bonobo | SEQ ID NOs FOR NHP 005 (also known as ape adenovirus AH16 herein)- Isolated from Urangutan | SEQ ID NOs FOR NHP 008 (also known as Ape adenovirus AH35 herein)- isolated from Gorilla |
|---|---|---|---|
| Protein E3 19kD | 118 | 153 | 187 |
| Protein E3 CR1-alpha | 119 | 154 | N/A |
| Protein E3 CR1-beta/gamma | 120 | N/A | N/A |
| Protein E3 RID-alpha | 121 | 155 | 189 |
| Protein E3-RID beta | 122 | 156 | 190 |
| Protein E4 34K/E4ORF6 | 123 | 157 | 191 |
| Protein E4 ORF1 | 124 | 158 | 192 |
| Protein E4 ORF3 | 125 | 159 | 193 |
| Protein E4 ORF4 | 126 | 160 | 194 |
| Protein E4 ORFB | 127 | 161 | 195 |
| Protein fiber | 128 | 162 | 196 |
| Protein hexon | 129 | 163 | 197 |
| Protein IVa2 | 130 | 164 | 198 |
| Protein IX | 131 | 165 | 199 |
| Protein penton base | 132 | 166 | 200 |
| Protein pIIIa | 133 | 167 | 201 |
| Protein pol | 134 | 168 | 202 |
| Protein protease | 135 | 169 | 203 |
| Protein pTP | 136 | 170 | 204 |
| Protein pV | 137 | 171 | 205 |
| Protein pVI | 138 | 172 | 206 |
| Protein pVII | 139 | 173 | 207 |
| Protein pVIII | 140 | 174 | 72 |
| Protein pX | 141 | 175 | 188 |
| Protein E1A 13S | 208 | 209 | 212 |
| Protein E4 ORF6 |  |  | 215 |
| Protein E4 ORF2 |  |  | 216 |

SEQUENCE LISTING (218 sequences)

SEQ ID NO: 1 - DNA, 35605 bp, Ape adenovirus AH34
catcatcaataatataccttataaatggaacggtgccaacatgcaaatgagcttttgaaaatggagggcggaaggggattggccagcgggttcaacggtcaaaaggggcgggccggcgcggggaggtgacgttttagtgtgggaggagttatgttgcaagttctcgcggtaaatgtgacgtaaaacgaggtgtggtttgaacacggaagtggatagttttcccgcgctgactgacaggatatgaggtagttttgggcggatgcaagtgaaaattctccattttcgcgcgaaaactgaatgaggaagtgaatttctgagtaatttcgagtttatgacagggcggagtatttaccgagggccgagtagactttgaccgattacgtggaggtttcgattaccgtgtttttcacctaaatttccgcgtacggtgtcaaagtcctgtgtttttacgtaggcgtcagctgatcgctagggtatttaaacctgacgagttccgtcaagaggccactcttgagtgccagcgagaagagatttctcctccgcgccgcgagtcagatctccactttgaaaaatgagacacctgcgattcctgcctcaggaaatctccattgcgaccgggaatgaaatactgcagtttgtggtagatgccctgatgggagacgatccggagccgcctgcgcagcctttcgatcctcctacgcttcatgaactgtatgatttagaggtagacgggccggaggatcctaacgaggaagctgtgaatgggtttttcagcgattctatgctattagctgctagtgaaggagtggacttagacccaccttctgagacccttgataccccaggggtggtggtggaaagcggcagaggtgggaaaaaattgcctgaacttggtgctgctgaaatggatttgcactgttatgaagagggctttcctccgagtgatgatgaagatgaggaaaatgtgcagtcgatccagaccgcagcgggtgagggaatgaaagctgccaatgatggttttaagttggactgcccggagctgcctggacatggctgtaagtcttgtgaatttcacaggaatagtactggactaaaagaactgttgtgctcgctttgctatatgagaacgcactgccattttatttacagtaagtgtgtttaacttaaatttaaagggacagtgtagcagtgttaataactgtgaatgtgggatttatgttttttgcgtgtgatttttataggtcctgtgtctgatgctgatgaatcgccttctcctgattcaactacctcacctcctgaaattcaggcgccagtccctgcaaacgtatgcaagcccattcctgtgaaggctaagcctgggaaacgccctgctgtggataagctggaggacttgcttgagggtggggatggacctttggacttgagtacccggaaactgccaaggcaatgagtaccctgcacctgtgtttatttaatgtgacgtcagtatttatgtgagagtgccatgtaataaaattatgtcagcttctgagtattttattgcttcttgggtggggacttggatatataagtaggagcagacctgtgtggttagctcacagcagcttgctgccatccatggaggtttgggctatcttggaagatctcagacagactaggcaactgctagaaaacgcctcggacggagtctctagtctttggagattctggttcggtggtgatctagctaggctagtctttagggtaaaacgggagtatagtgaagaatttgaaaagttattggaagacagtccaggactttttgaagcccttaacttgggccaccaggctcattttaaggagaaggttttatcagttttagatttttctacccctggtagaactgctgctgctgtagcatttcttacttttatattggataaatggatcccacaaacccacttcagcaagggatacgtcttggatttcatagcagcagctttgtggagaacatggaaggcccgcaggctgaggataatcttagattactggccagtgcagcctctgggcgtagcggcaatcctgagacacccaccggccatgccagcggttctggaggaggagcagcaggaggacaacccgagagccggcctggaccctccggtggaggaggcggaggagtagctgacctgtttcctgaactgcgacgggtgcttactaggtctacgtccagtggacaggacaggggcattaagagggagaggaatgctagtgggcataattcaagaactgagttggctttaagtttaatgagtcgcagccgccctgaaactatctggtggcatgaggttcagagcgagggcagggatgaagtttcaatattgcaggagaaatattctctagaacaaattaaaacctgttggttggaacctgaggatgattgggaggtggccattaggaattatgctaagatatctctgaggcctgataaacagtatagaattaccaagaagattaatatcagaaatgcatgctacatatcagggaatggggcagaggttataatagatacaccagataaaacagcttttaggtgttgtatgatgggtatgtggccaggggtggctggtatggaggcagtaacccttatgaatataaggtttaggggagatgggtataatgggattgtctttatggctaacactaaattaattctgcacggttgtagcttttttgggtttaataatacttgtgtggaagcatggggacaggttagtgtaagaggttgtagtttttatgcaggctggattgcactatcaggcagaaccaagagtcagttgtctgtgaagaaatgcatgtttgagagatgtaacctgggcatactgaatgaaggcgaagcaagggtccgccactgcgctgctacagaaactggctgcttcattctaataaagggaaatgccagtgtgaagcataacatgatctgtggaccctcggatgagaggccttatcagatgctgacctgtgctggaggacattgcaatatgctggctactgtgcatattgtttctcatgcacgcaagaaatggcctgtttttgaacataatgtgatgaccaagtgcaccatgcacgcaggtggtcgcaggggaatgtttatgccttaccagtgtaacatgaatcatgtgaaggtgatgttggaaccagatgccttttccagaatgagcttaacaggaatctttgatatgaatgtgcaactatggaagatcctgagatatgatgagaccaaatcgagggtgcgcgcatgcgagtgcgggggcaagcatgccaggttccagccggtgtgtgtggatgtgacggaagacctgagacccgatcatttggtgcttgcctgcactggagcggagttcggttctagtggggaagaaactgactaaagtgagtagtggggaatgctgtggagggggcttccaggcgggtaaggtgggcagattgggtaaattctgtttgtttctgtcttgcagctgtcatgagtggaagcgcttcttttgaggggggagtctttagtccttatctgacgggacgactcccaccctgggcaggagttcgtcagaatgtcatgggatcaactgtagatgggagacccgtccagcccgccaattcctcaacgctgacctatgccactttgagctcttcatccttggatgcagccgcagccgctgccgcctctgctgccgccaacaccgtccttggaatgggctattatggaagcatcgttgccaattccagttcctcaaataacccttcgaccctggctgaggacaagctacttgtcctcttggctcagctcgaggccttgacccagcgcctaggcgaactgtctcagcaggtggcccagttgcgcgagcaaactgagtctgctgttgccacagcaaagtctaaataaagattcccaaatcaataaataaaggagatccttgttgattgtaaaacaagtgtaatgaatctttatttgatttttcgcgcgcggtatgccctggaccaccggtctcgatcattgagaactcggtggatcttttccaggaccctgtagaggtgggattgaatgtttagatacatgggcattaggccatctcgggggtggagatagctccattgaagagcctcatgctccggggtagtgttataaatcacccagtcataacaaggtcggagtgcatggtgttgcacaatatcttttaggagcaggctaattgcaacggggaggcccttagtgtaggtgtttacaaatctgttgagctgggacgggtgcattcggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttcgagacgcctttgtgtccgcccagattctccatgcactcatccataatgatagcaatggggccgtgggcggcggcgcgggcaaacacgttccgggggtctgacacatcatagttatgctcctgagtcaggtcatcataagccattttaataaacttggggcggagggtgccagattgggggatgaaagttccctcgggccccggagcatagtttccctcacatatttgcatttcccaggctttcagttcagagggggggatcatgtccacctgcggggctataaaaaataccgtttctggagcgggggtgattaactgggatgagagcaaattcctgagcagctgagacttgccacacccagtgggaccgtaaatgaccccgattacgggttgcagatggtagtttagggagcggcagctgccgtcctcccggagcaggggggccacttcgttcatcatttcccttacatggatattttcccgcaccaagtccgttaggaggcgctctccccccagggatagaagctcctggagcgaggagaagtttttcagcggcttcagcccgtcagccatgggcatttttgagagagtctgttgcaagagctcgagccggtcccagagctcggtgatgtgttctatggcatctcgatccagcagacctcctcgtttcgcgggttggggcggctcctggagtatggtatcagacgatgggcgtccagcgctgccagggtccgatctttccagggtcgcagcgtccgagtcagggttgtttccgtcacggtgaatgggtgcgcgcctggttgggcgcttgcgagggtgcgcttcaggctcatcctgctggtcgagaaccgttgccgatcggcgccctgcatgtcagccaggtagcagtttaccatgagttcatagttgagcgcctcggccgcgtgacctttggcgcggagcttacctttggaagttttctggcagacggggcagtacagacacttgagggcatacagtttgggagcaaggaaaatggattcgggggagtatgcatccgcaccgcaggaggcgcagacggtttcgcactccacgagccaggtcagatccggctcatcggggtcaaaaacaagttttccaccatgttttttgatgcgtttcttacctttggtctccatgagttcgtgtccccgctgggtgacaaagaggctgtccgtgtccccgtagaccgattttatgggcctgtcctcgagcggagtgcctcggtcctcttcgtagaggaactcggaccactctgatacaaaggcgcgcgtccaggccagcacaaaagaggccacgtgggaggggtagcggtcgttgtcaaccagggggtccaccttctccacggtatgtaaacacatgtccccctcctccacatccaggaatgtgattggcttgtaagtgtatgccacgtgaccaggggtccccgccgggggggtataaaagggggcgggtctctgctcgtcctcactgtcttccggatcgctgtccaggagcgccagctgttggggtaggtattccctctcgaaggcgggcataacctctgcactcaggttgtcagtttctaggaacgaggaggatttgatattgacagtgccagccgagatgcctttcatgagactctcgtccatttggtcagaaaatacaatcttcttgttgtccagcttggtggcaaaggatccatagagggcattggataggagcttggctatggagcgcatggtttggttcttttccttgtcagcgcgctccttggcagcaatgttgagctggacatactcgcgcgccagacacttccattcagggaagatggttgtcagttcatctggcacgattctgactcgccagcccctattatgcagggttatcagatccacactggtggtcacttcgcctctgaggggctcattggtccagcacagtcgacccccttttctcgaacagaaaggggggagggggtctagcatgagttcatcaggggggtctgcatccatggtgaagattcctgggagtaggtccttgtcaaaatagctaatgggggtggggtcatccaaagccatctgccattctcgagctgccagcgcgcgctcataggggttgagtggggtgccccagggcatggggtgggtgagcgcagaggcatacatgccacagatatcatagacatagaggggctcttcgaggatgccaatgtaggtgggataacagcgcccccctctgatgcttgctcgcacatagtcatagagttcatgcgagggggcgagcagacccgagcccagattagtgcgattgggtttttcagccctgtaaacgatctggcgaaagatggcatgtgaatttgaagagatggtgggtctttgaaagatgttaaaatgggcatgaggtagacctacagagtccctgataaagtgggcatatgactcttgcagcttggccaccagttcggcagtgacaaggacatccaaggcgcagtagtcaagggtctcttggatgatgtcataacctggttggtttttcttttcccacagctcgcggttgagaaggtattcttcgcgatccttccagtactcttcgaggggaaacccgtctttgtctgcacggtaagagcccagcatgtagaactgattaactgccttgtagggacagcaacccttctccacggggagagagtatgcttgggctgccttgcgcagtgaggtatgagtgagggcgaaggtgtccctgaccatgactttgaggaactggtacttgaaatcgatgtcatcacaggccccctgttcccagagttggaagtccacccgcttcttgtaggcggggttgggcaaagcgaaagtaacatcattgaagagaattttgccggccctgggcatgaaattgcgggtgatgcggaaaggctggggcacctctgcccggttattgatcacctgagcggccaggacgatctcatcaaagccattgatgttgtgccccacaatgtaaagttctatgaatcgcggggtgcccctgacatgaggcagcttcttgagttcttcaaaagtgaggtctgtagggtcagagagagcatagtgttcgagggcccattcgtgcaggtgagggtttgcagtgaggaaggaggaccagagatccactgccagtgctgtttgtagctggtcccgatactggcgaaaatgctggccgactgccatcttttctggggtgatacagtagaaggttttggggtcttgctgccagcgatcccacttgagtttcatggcaaggtcgtaggcgatattgacgagccgctcgtcccccgaaagtttcatgaccagcatgaaggggattagctgcttgccaaaggaccccatccaggtgtaggtttccacatcgtaggtgaggaagagcctttctgtgcgaggatgagagccgattgggaagaactggatctcctgccaccagttggaggaatggctgttgatgtgatggaagtagaactccctgcggcgcgccgagcattcatgcttgtgcttgtacagacggccgcagtactcgcagcgcttcacgggatgcacctcatgaatgagttgtacctggcttcctttgacgagaaatttcagtgggaagttgaggcctggcgcttgtacctcgcgctctactatgttatctgcatcggcctggccatcttctgtctcgatggtggtcatgctgacgagcccccgcgggaggcaagtccagacctcggcgcgggaggggcggagctcgaggacgagagcgcgcaggccggagctgtccagggtcctgagacgctgcggagtcaggttagtaggtagtgtcaggagattaacttgcatgatcttttcgagggcatgcgggaggttcagatggtacttgatttccacgggtccgttggtggtgatgtcgatggcttgcagggtcccatgccccttgggcgcgaccaccgtgcccttgtttttccttttgggcggaggaggcggctctgttgcttcttgcatgttcagaagcggtggcgagggcgcgcgccgggcggtaggggtggctcgggccccggcggcatggctggtagaggcacgtcggcgccgcgcgcgggtaggttctggtactgcgccctgagaagacttgcgtgcgcgacgacgcggcggttgacgtcctggatctgacgcctctgggtgaaagctaccggacccgtgagcttgaacctgaaagagagttcaacagaatcaatttcggtatcgttgacggcggcttgcctcaggatctcttgcacgtcgcccgagttgtcctggtaggcgatctcggccatgaactgctcgatttcttcctcctgaagatctccgcggcccgctctctcgacggtggccgcgaggtcgttggagatgcgacccatgagttgagagaatgcattcatgcccgcctcgttccagacgcggctgtagaccacggccccctcgggatctctcgcgcgcatgaccacctgggcgaggttgagctccacgtggcgggtgaagaccgcatagttgcataggcgctggaagaggtagttgagtgtggtggcgatgtgctcggtgacgaagaaatacatgatccatcgtctcagcggcatttcgctgacatcgcccagggcttccaagcgctccatggcctcgtagaagtccacagcgaagttgaaaaactgggagttgcgcgcggacacggtcaactcctcttccagaagacggatgagatcggcgatggtggcgcgcacctcgcgctcgaaggcccccgggatttcttcctcctcctcttctatctcttcttccactaacatctcttcttcctcttcaggcgggggcggaggaggagggggcgcgcggcgacgccggcggcgcacgggcagacggtcgatgaatctttcaatgacctctccgcggcggcggcgcatggtctcggtgacggcgcggccgttctccctgggtctcagagtgaagacgcctccgcgcatctccctgaagtggtgactggggggttctccgttgggcagggacagggcgctgatgatgcattttatcaattgccccgtagggactccgcgcaaggacctgatcgtctgaagatccacgggatctgaaaacctttcgacgaaagcgtctaaccagtcgcaatcgcaaggtaggctgagcactgtttcttgcgggcgggggtggctagacgctcggtcggggttctctcttccttctccttcctcatcatctcgggagggtgagacgatgctgctggtgatgaaattaaaataggcagttctgagacggcggatggtggcgaggagcaccaggtctttgggtccggcttgctggatgcgcaggcgatcggccattccccaagcattgtcctggcatctggccagatctttatagtagtcttgcatgagtcgctccacgggcacttcttcttcgcccgctctaccatgcatgcgcgtgagtccgaacccgcgcatgggctggacaagtgccaggtccgctacgaccctttcggcgaggatggcttgctgcacctgggtgagggtggcttggaagtcgtcaaagtccacgaagcgatggtaggccccggtgttgatggtgtaggagcagttggccatgactgaccagttgactgtctggtgccccgggcgcacgatttcggtgtacttgagtcgcgagtaggcgcgggtgtcaaagatgtaatcgttgcaggtgcgcaccaggtactggtagccgatgagaaagtgcggcggtggctggcggtagaggggccatcgctctgtagccggggctcctggggcgaggtcttccagcatgaggcggtggtatccgtagatgtacctggacatccaggtgatcccggaggcggtggtggacgctcgcgggaactcgcgcactcggttccagatgttgcgcagcggcataaagtagttcatggtaggcacggtctggccagtgaggcgggcgcagtcattgatgctctatagacacggagaaaacgaaagcgatgagcggctcgcctccgtggcctggaggaacgtgaacgggttgggtcgcggtgtaccccggttcgagacacgagccaagcgagcacaactcgggccggccggagccgtggctaacgtggtattggcgatcccgtctcgacccagccgacgaatatccaggatacggagtcgagtcgttttgctgcttgttgcttttcctggacgggagccagtgccgcgtcaagctttagaacgctcagttcacggggccgggagtggctcgcgcccgtagtctggagaatcaatcgccagggttgcgttgcggtgtgccccggttcgagccttaacgcggcccggatcggccggtttccgcggcaagcgagggtttggcagccccgtcatttctaagaccccgccagccgacttctccagtttacgggagcgagccctctttttttttgttttttgtcgcccagatgcatcccgtgctgcgacagatgcgcccccagcaacaggccccttctcagcaacagcagcagccacaaaaggctcttcctgctcctgctcctgcaactactgcagtcgcagccgtgtgcggcgcgggacagcccgcctatgatctggacttggaagagggcgagggactggcgcgcctgggtgcaccatcgcccgagcggcacccgcgggtacaactgaaaaaggactctcgcgaggcgtacgtgccccagcagaacctgttcagggacaggagcggcgaggagcccgaggaaatgcgagcctctcgctttaacgcgggtcgcgagctgcgtcacggtctggaccgaagacgggtgctgcgggacgaggatttcgaggtcgatgaagtgacagggatcagccccgctagggcacatgtggccgcggcaaacctcgtctcggcctacgagcagaccgtgaaggaggagcgcaacttccaaaaatctttcaacaaccatgtgcgcaccctgatcgcccgcgaggaagtgaccctgggtctgatgcacctgtgggacctgatggaagctatcacccagaaccccactagcaaacccctgaccgctcagctgtttctggtggtgcaacacagcagggacaatgaggcatttagggaggcgctgctgaacatcaccgagcccgaggggagatggttgtatgatctgatcaatatcctgcaaagtattatagtacaggaacgcagcctgggtctggccgagaaagtggcagctatcaactactctgtcttgagcctgggcaagtactacgctcgcaagatctacaagaccccctacgtgcccatagacaaggaggtgaagatagatgggttttacatgcgcatgactctgaaggtgctgactctcagtgacgatctgggggtgtaccgcaacgacaggatgcaccgcgcggtgagcgccagcaggaggcgcgagctgagcgacagagaacttatgcacagcttgcaaagagctctgacgggggcagggaccgagggggagaactactttgacatgggagcggacttgcaatggcagcctagccgcagggccctggacgcagcagggtgtgagcttccttacatagaagaggtggatgaaggcgaggaggaggagggcgagtacctggaagactgatggcgcgacccgtatttttgctagatggaacagcaggcaccggaccccgcaatgcgggcggcgctgcagagccagccgtccggcattaactcctcggacgattggacccaggccatgcaacgcatcatggcgctgacgacccgcaatcccgaagcctttagacagcaaccccaggccaaccgcctttcggccatcctggaggccgtagttccttcccgctccaaccccacccacgagaaggtcctggccatcgtgaacgcgctggtggagaacaaggccatccgccccgatgaggccgggctggtatacaatgccctcttggagcgcgtggcccgctacaacagcagcaacgtgcagaccaacctggaccggatggtgaccgatgtgcgcgaggccgtgtctcagcgcgagcggttccagcgcgatgccaacttggggtcgctggtggcgctgaacgccttcctcagcacccagcctgccaacgtgccccgcggccagcaagactatacaaactttctaagtgcactaagactcatggtaaccgaagtccctcagagcgaggtgtaccagtccggaccagactactttttccagaccagcagacagggcttgcagacagtgaacctgagccaggctttcaagaacctcagaggcctgtggggagtgcacgctccagtaggagatcgtgcgaccgtgtctagcttgctgacccccaactcccgcctactgctgctgctggtatcccccttcactgacagcggtagcatcgaccgcaactcctacttgggctacctgctgaacttgtatcgcgaggccatagggcagagccaggtggacgagcagacctaccaagaaatcacccaagtgagccgcgccctgggtcaggaagacacgggcagcttggaagccaccctgaacttcttgctgaccaaccggtcgcagaagatccctcctcagtatgcgcttaccgcggaggaggagcggatcctcagatatgtgcagcagagcgtgggactgttcctgatgcaggagggggcgactcctagtgccgcgctggacatgacagcgcgaaacatggagcccagcatgtatgccagtaaccggcctttcattaacaaactgctggactacctgcacagggcagccgccatgaactctgattatttcaccaatgctatcctcaacccccactggctgcccccgcctggattttacacgggcgagtatgatatgcccgaccccaatgacgggtttctgtgggacgatgtggacagcagcatattctccccgcctcctggttataacacttggaagaaggaagggggcgatagaagacactcttccgtgtcgctgtccgggtcgaggggtgctgccgctgcggtgcccgaggctgcaagtcctttccctagcctgcccttttctctgaacagcgtgcgcagcagtgaactggggagaataacccgcccgcgcttgatgggcgaggatgagtacttgaacgactccttgcttagacccgagagggaaaagaacttccccaacaatgggatagagagcctggtggataagatgagtagatggaagacttatgcacaggatcacaaagacgagcctaggatcttgggggctgcaagtgggactacccgtagacgccagcgccatgacagacagaggggtcttgtgtgggacgatgaggactcggccgatgacagcagcgtgttggacttgggtgggagaggagggggcaacccgttcgctcatctgcgcccgcactttgggcgcatgttgtaaaagtgaaagtaaaataaaaaaggcaactcaccaaggccatggcgacgagcgtgcgttcgttcttttctgttatctgtgtctagtatgatgaggcgagccgtgctaggcggagcggtggtgtatccggagggtcctcctccttcgtacgagagcgtgatgcagcagcaggcggcggcggtgatgcagccctcgctggaggctccctttgtacccccgcggtacctggcgcctacagaggggaggaacagcattcgttactcggagctggcaccccagtacgataccaccaggttgtatctggtggataacaagtcggcggacatcgcctcattgaactatcagaacgaccacagcaacttcctgaccacggtggtgcagaacaatgactttacccccacggaggccagcacccagaccatcaactttgacgagcggtcgcggtggggcggtcagctgaagaccatcatgcacaccaacatgcccaacgtgaacgagtacatgttcagtaacaagttcaaggcgcgggtgatggtgtcccgcaagaaacctgaaggctatacaggggatgaaaatgatacaagtcaggatattctggagtatgagtggtttgagttcactttaccagaaggcaacttctcagccaccatgaccatcgacctgatgaacaatgccatcattgacaactacttggcagtgggtagacagaatggagtgctgcaaagtgacatcggtgtcaagtttgataccaggaacttcaggctgggctgggaccctgtaactaaacttgttatgccaggggtgtacacttatgaagccttccatcctgatattgttctactacctgactgtggggtggactttactgaaagccgccttagcaacttgcttggcatcaggaagagacacccattccaggaaggcttcaagataatgtatgaggatctcgaagggggcaatatccccgcccttctggatgtacaagcctatgaagagagcaaaaaggcaaatgcaggcaccaccaccactactactacaactgaagtgacaaccgtcgctgttgctaatgcactaactacttcagctaaagcggtagcaaatgtaacagtagatgctattactgaagcaaacaataatgcaatcagaggagataattacctacctgctaatgccatgaaagaatctggggaaacaactgtggtgccggtaattcccatacctgaaactcaaactgaaactgaaactgaaaccaaagaaccaaccattaaacctctagaaaaggataccaaggatcgcagttacaatgtcatctctggcaccaatgatactgcctatcgcagttggtacctagcatacaactatggcgaccctgaaaaaggagtccgctcctggacactgctcaccacttcagatgtcacctgcggagcggagcaagtatattggtcgctccctgacatgatgcaggaccccgtcaccttccgatccacgagacaagtcagcaactaccccgtggtgggtgcagagctcatgcccgtcttctcaaagagtttctacaatgagcaagccgtatactcccagcagctccgccagaccacctcgctcacgcacatcttcgatcgcttccctgagaatcagatcctcatccgcccgccggcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaaaaaatgtccattctcatctcacccagtaataacaccggttgggggctgcgcacacccaccaggatgtacggaggcgctcgcaaacggtctacccagcaccctgtgcgtgtgcgcgggcatttccgcgctccctggggcgccctcaagggccgtactcgcactcggaccaccgtcgatgatgtgatcgaccaggtggttgcagatgctcgtaattatactcctgctgcacctgcatctactgtggatgcagttattgacagcgtggtggctgacgctcgcgagtatgctcgccggaagagcaggcgaagacgcatcgccaggcgccaccgggctacccccgctatgcgagctgcaagagctctgctgcggagagccaaacgcgtggggcgaagagccatgcttagagcggccagacgcgcggcttcaggtgccagcgcaggcaggtcccgcaggcgcgcggccacggcggcagcagcggccattgccaacatggcccaaccgcgaagaggcaatgtgtactgggtgcgcgatgccactaccggtcagcgcgtgcccgtgcgcacccgtccccctcgcacttagaagatactgagcagtctccgatgttgtgtcccagcggcgaggatgtccaagcgcaaatacaaggaagagatgctccaggtcatcgcgcctgaaatctacggtccaccggtgaaggatgaaaaaaagccccgcaaaatcaagcgggtcaaaaaggacaaaaaggaagaagatggcgatgatgggctggtggagtttgtgcgcgagttcgctccaaggcggcgcgtgcagtggcgcgggcgcagggtgcggccggtgctgagaccaggaaccacggtggtctttacgcccggcgaacgctccagcactacttttaaacgctcctatgatgaggtgtacggggatgatgatattctggagcaggcggccgaccgcctgggcgagtttgcttatggcaaacgcagccgctccagtcctaaggaggaggcggtgtccatccccttggatcatggaaatcccaccccgagtcttaaaccagtcaccctgcagcaagtgctacccgtgcctccacggagaggtgtcaagcgagagggcgaggatctgtatcccaccatgcaactgatggtgcccaagcgccagaagctggaggacgtgctggagaaaatgaaagtggatcccgatatccagcctgaagttaaagtcagacccatcaagcaggtggcgcccggtctgggagtgcaaaccgtggacatcaagattcccaccgagtccatggaagttcagactgaacctgcaaagcctacagccgcctccattgaggtgcagacggatccatggatgcccgcgcccattgcaaccacagccagtaccgctcgaagaccccggcgaaagtatggtcctgcgagtctgttgatgcccaattatgctctgcacccatccattattccaactcctggttaccgaggcactcgctactaccgcagccggagcactacttcccgccgccgcaaaacacctgcaagccgcagtcgccgtcgccgccgccgcaccaccagcaaactgactcccgccgctctggtgcggagggtgtatcgcgatggccgcgcggaccccctgatgctgccgcgcgcacgctaccatccaagcatcaccacttaatgactgttgccgctgcctccttgcagatatggccctcacttgccgccttcgcgtccccattactggctaccgaggaagaaactcgcgccgtagaaggatgttgggtagcgggatgcgtcgccacaggcggcggcgcgccaccagcaggaggctggggggtggctttctgaccgctttgattcccatcatcgccgcggcgattggggcggtaccaggcatagcttccgtggcggttcaggcctcgcagcgccactgacattggaaaaaaaacttataaataaaatagaatggactctgacgctcctggtcctgtgactatgtttttgtagagatggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcgctgaggaataagcttaaagagcagaacttccagcagaaggtggtcgatgggatcgcctctggtatcaatggggtggtggatctggccaaccaggccgtgcagaaacagataaacagccgcctggacccgccgcccgcagcccctggcgaaatggaagtggaggaagagctccctcccctggaaaagcggggagacaagcgcccgcgtcccgatatggaggagacgctggtgacgcgcggagacgagccgcctccatacgaggaggcaataaagcttggaatgcccactaccaggcctatagctcccatggccaccggggtaatgaaaccttctcagtcgcatcgacccgccaccttggacttgcctcctgcccctgctgctgcagcgcccgctccaaagcctgtcgctaccccgaagcccacctccgtacagcccgtcgccgtagccagaccgcgtcctgggggcactccgcgcccgaatgcaaactggcagagtactctgaacagcatcgtgggtctgggcgtgcagagtgtaaagcgccgtcgctgctattaattaaatatggagtagcgcttaacttgcttgtctgtgtgtatgtgtcatcaccacgccgccgcagcagcagaggagaaaggaagaggtcgcgcgccgaggctgagttgctttcaagatggccaccccatcgatgctgccccagtgggcatacatgcacatcgccggacaggatgcttcggagtacctgagtccgggtctggtgcagttcgcccgtgccacagacacctacttcaatctggggaacaagtttaggaaccccaccgtggctcccacccacgatgtgaccaccgaccgaagccagcggctgatgctgcgctttgtgcccgttgatcgggaggacaatacctactcatacaaagttcgctacacactggctgtgggcgacaacagagtgctggatatggccagcaccttctttgacatccggggggtgctggacagaggtcccagcttcaaaccctactctggcacagcttacaactcgctggctcctaagggagctcccaatacatgtcagtggattgccaagggggcgcctgttaccgatcaagccaatcaagatgacggagaaaatgaagaacaggaattaacagatgttacttacgcttttggcaatgctccagtgcaagcagaagccaaaattacaaaagatggtctgccagtaggtttggaaattacagaagatgaacaaaagccaatatatgctgacaaattgtatcagccagaaccccaaattggcgatgaacagtggcatgacaccactggtactaatgaacaatacggaggcagagctctaaaaccggccacaaacatgaaaccatgctatggctcatttgccagacccacaaataaaaaaggcggtcaggctaaaactagaaaaatagaaaaagaagaaaatggagttaaaaccgtaactgaagaagctgacattgatatggacttttatgacttaagatcacaaagagcaaattatgatcctaaaattgttctttattctgaaaatgtaaatttggaaactccagatacacatattgtgtataaaccaggaacagatgaaactagttcctctactaacttgggacagcaggcaatgcccaacaggcccaactacattggtttcagggacaactttgttggacttatgttttacaacagtactggcaacatgggcgtgctggccggtcaagcttctcagttgaatgctgtggtcgacttgcaggacaggaacacagaactgtcctaccagctgctgcttgactctctgggtgacagaaccagatactttagcatgtggaatcaggccgtggatagctatgacccagacgtgcgcattattgaaaaccacggtgtggaagacgaacttcctaactattgttttccattagatggagtggggccaattacgggcacttatcagggggttgagcctgatgatggaaacaatggaaactggaagaaaaacacaaaagtaaatggagcaaatgaaattggcaagggaaataactatgctatggaaattaatctacaagctaacctatggagaagttttctatactccaatgtggctctctatctgccagacggttacaaatataccccagccaatgttacactgccagaaaacaaaaatacctatggctatataaacggtcgagtagtatccccatctttggtggattcatacatcaacattggagccagatggtctttggatcttatggacaatgtaaaccccttcaatcaccaccgaaacgctgggctgcgctaccgatccatgcttctaggcaatggccgctatgtgcccttccacatccaagtgccacagaaattctttgctatcaagaacctgttacttcttcccggttcctacacctatgagtggaacttcagaaaggacgtgaacatggtcctacagagttcccttggcaacgaccttcgggttgatggagccagcatcagttttacaagcatcaacctctatgctacctttttccccatggcccacaacactgcttccaccctcgaagccatgctgcgcaatgacaccaatgaccagtcattcaatgactacctctctgcagccaacatgctctaccccattcctgccaatgccactaacattcccatctccattccatctcgcaactgggctgccttcaggggctggtcttttaccagactcaaaaccaaggagactccctctttgggatcagggttcgatccatactttgtctattcaggctccattccctacctggatggtaccttctacctcaaccacactttcaagaaggtctccatcatgtttgactcctcagtcagctggccaggaaatgacagattgctaacgccaaatgagtttgaaatcaagcgcactgtggatggggaagggtacaacgtggctcaatgcaacatgaccaaggattggttcttggtccagatgcttgccaactacaacattggctaccagggcttctacatcccagaggggtacaaggatcgcatgtactccttcttcagaaacttccagcccatgagcagacaggtagttgatgaagtcaattacaaggagtaccaagctgtcacacttgcttaccagcacaacaactctggttttgtgggttaccatgcacccactcttcgtcagggccaaccatacccagctaactacccctacccgctcattggaaccactgctgtcaccagcgtcacccagaaaaagttcttgtgtgacaggaccatgtggcgcatccccttctccagcaacttcatgtccatgggtgcccttaccgacctggggcagaacatgctttatgccaactcagcccatgcgctggacatgacttttgaggtggatcccatggatgagcccacactgctttatcttctttttgaagtcttcgacgtggtcagagtgcaccagccacaccgcggcgtcatcgaggctgtctacctgcgtaccccgttctcagctggtaacgccaccacataagaagcttcttgcttcttgcaagcagctgccatggcctgtgggtccggcaacggatccagcgagcaagagctcagggccattgctagagacctgggctgcggaccctatttcctgggaacctttgacaagcgattcccggggttcatggaccccgacaagctcgcctgtgccattgttaacacggccggtcgcgagacggggggtgagcactggctggcttttggttggaacccgcgctccaacacctgctacctttttgatccttttggcttctcggatgagcgcctcaagcaaatctaccagtttgagtatgagggtctcctgcgccgcagtgccctggctaccaaggatcgctgtatcaccctggaaaagtccacccagaccgtgcagggcccgcgctccgcagcctgtggacttttttgctgcatgttcctccacgcttttgtgcactggcccgaccgccccatggacggaaaccccaccatgaagttgttgactggggtgcccaacagcatgctccaatcaccccaagtccagcccaccctgcgccacaaccaggaggcgctctaccgcttcctcaatacccactcatcttactttcgttctcaccgcgcgcgcatcgaaaaggctaccgcgtttgaccgtatggatatgcaataataagtcatgtaaaaaccgtgtttcaaataaacagcactttattttttacatgcactgtggctctgggttgctcattcattcatcattcactcagaagtcgaaggggttctggcgggaatcagcgtgacccgctggcagggatacgttgcggaactggaacctgttctgccacttgaactcggggatcaccagtttgggaactaggatctcggggaaagtgtcttgccacagctttctggtcagttgcagagcgccgagcaggtcaggagcagagatcttgaaatcacagttggggccagcattctgagcgcgggagttgcggtacactgggttacagcactggaacaccatcagggcggggtgtcttacgctcgccagcacggtcgggtcactgatggtagtcacatccaagtcttcagcattggccattccaaagggggtcatcttacaggtctgcctgcccatcacgggagcgcagccgggcttgtggttgcaatcgcagtgaatggggatcagcatcatcctggcctggtcgggggttatccctggatacaccgccttcataaaggcttcgtactgcttgaaagcttcctgggccttgcttccctcggtgtagaacatcccacaggacttgctggaaaattgattagtagcacaattggcatcattcacacagcagcgggcatcgttgttggccagctggaccacattcctgccccagcggttctgggtgatcttggctcggtctgggttctccttcatcgcgcgctgtccgttctcgctcgccacatccatctcgatgatgtgatccttctggatcatgatagtgccatgcaggcatttcaccttgccttcataatcggtgcagccatgagcccacagagcgcacccggtgcactcccaattgttgtgggcgatctcagaataagaatgcgccaaaccctgcaggaatcttcccatcattgtagtcagggtcttcatgctagtaaaggtcagcggaatacctcggtgctcctcgttcacatactggtggcagatacgcctgtactgctcgtgctgctcgggcatcagcttgaaagaggttctcaggtcattatccagcctatacctctccatcagtacggccattacttccatgcccttctcccaggcagataccaagggcaggctcatgggattcctaacagcaatagagctagcagctgcagctcctttagccagagggtcattcttgtcaatcttctcaacacttctcttgccatccttctcagtgatgcgcacgggtgggtagctgaagcccacggccaccagctccgcctgttctctttcttcttcgctgtcctgactgatgtcttgcagagggacatgcttggtcttcctgggcttcttcttgggagggatcgggggagggctgttgctccgctccggagacagggaggaccgcgaagtttcgctcaccagtaccacctggctctcggtagaagaacctgaccccacacggcggtaggtgttcctcttcgggggcagaggtggaggcgactgcgatgggctgcggtccggcctgggaggcggatggctggcagagcctcttccgcgttcgggggtgtgctcccggtggcggtcgcttgactgatttcctccgcggctggccattgtgttctcctaggcagagaaacaacagacatggagactcagccatcgctgccaacaccgctgcaagcgccatcacacctcgcccccagcagcgacgaggaggaacagagcttaaccaccccaccacccagtcccgccaccaccacctctaccctcgatgaggaggaagaggtcgacgcaccccaggagatgcaggatatggaggatgagaaagcggaagagattgaggcagatgtcgagcaggacccgggctatgtgacaccggcggagcacgaggaggagctgagacgctttctagacagagaggataacaaccgcccagagcagcaagcagatggcgatcaccaggaggctgggctcggggatcatgtcgccgaatacctcaccgggcttggcggggaggacgtgctcctcaaacatctagcaaggcagtcgatcatagttaaagacgcactgctcgaccgcaccgaagtgcccatcagtgtggaagagctcagccgcgcctacgagctcaacctgttctcgcctcgggtgcctcccaagcgtcagccaaacggcacctgcgagcccaaccctcgcctcaacttctatccggcctttgctgtcccagaagtgcttgctacctaccacatctttttcaagaaccaaaagattccagtctcctgccgtgccaaccgcacccgcgccgatgccctgctcaacttgggaccgggcgctcgcttacctgatatagcttccttggaagaggttccaaagatcttcgagggtctgggcagtgatgagactcgggccgcaaatgctctgcaacagggagagaatggcatggatgaacatcacagcgcgctggtggagttggagggcgacaatgcccggcttgcagtgcttaagcgcagtatcgaggtcacccattttgcctaccccgctgttaacctgccccccaaagtcatgagcgctgtcatggaccagctgctcatcaagcgcgcaagccccctttccgaagaccagaacatgcaggatccagacgcctctgacgagggcaagccggtggtcagtgacgagcagctgtctcgctggctggccaccaactccccgcgagacttggaagagaggcgcaagcttatgatggctgtagtgctagtcactgtggagctggagtgtctccgccgctttttcaccgaccctgagaccctgcgcaagcttgaggagaacctgcactatactttcagacatggcttcgtgcgccaggcatgcaagatctccaacgtggagctcaccaacctggtctcctacatgggcattttgcatgagaaccgcctggggcagagcgtgttgcacaccaccctgaagggggaggcccgccgcgactacatccgcgactgtgtctacctctacctctgccatacctggcagactggcatgggtgtatggcagcagtgtttggaagagcagaacctgaaagagctggacaagctcttgcagagatccctcaaagccctgtggacaggttttgacgagcgcaccgtcgcctcagacctggcagacatcatctttcccgagcgtctcagggttactctgcgcaacggcctgcctgacttcatgagccagagcatgcttaacaactttcgctctttcatcctggaacgctccggtatcctgcccgccacctgctgcgcgctgccctccgactttgtgcctctcacctaccgcgagtgccccccgccgctatggagccactgctacctgttccgcctggccaactacctctcctaccactcggatgtgatcgaggatgtgagcggagacggcctgctggagtgccactgccgctgcaatctttgcacaccccaccgttccctcgcctgcaacccccagttgctgagcgagacccagatcatcggcaccttcgagttgcagggtcccagcagtgaaggcgaggggtcttctccggggcagagtctgaaactgaccccggggctatggacctccgcctacctgcgcaagttcgcccctgaagactaccacccctatgagatcaggttctatgaggaccaatcacagccgcccaaaaccgagctctcagcctgcgtcatcactcagggggcaattctcgcccaattgcaagccatccaaaaatctcgccaagaatttctgctgaaaaaggggaacggggtctacctcgacccccagaccggtgaggagctcaacacaaggttccctcaggatgtcccagcgccgaggaagcaagaagttgaaggtgcagctgccgcccccagaggatatggaggaagactgggacagtcaggcagaggaggaggagatggaagattgggacagccaggcagaggaggcggacagcctggaggaagacagtttggaggaggaagacgaggaggcagaggaggtggaagaaacaaccgccgccaaacagttgtcctcggcagcggagacaagcaaggtcccagacagcagcagcagcacggctacaatctccgctccgggtcggggggcccagcggcgtcccaacagtagatgggacgagaccgggcgattcccgaacccgaccaccgcttccaagaccggtaagaaggagcggcagggatacaagtcctggcgggggcataagaatgccatcatctcctgcttgcatgaatgcgggggcaacatatccttcacccggcgctacctgctcttccaccacggggtgaacttcccccgcaatgtcttgcattactaccgtcacctccacagcccctactacagccagcaagtcccggcagcctcggcagagaaagacagcagcagcggggacctccagcagaaaaccagcagcagcagttagaaaatccagtgcagcaggaggaggactgaggatcacagcgaacgagccagcgcagacccgagagctgagaaacaggatctttccaaccctctatgccatcttccagcagagtcgggggcaagagcaggaactgaaagtaaaaaaccgatctctgcgctcgctcacccgaagttgtttgtatcacaagagcgaagaccaacttcagcgcactctcgaggacgccgaggctctcttcaacaagtactgcgcgctgactcttaaagagtagcccgcgcccgcgctcgctcgaaaaaggcgggaattacgtcacccttggcacctgtcctttgccctcgtcatgagtaaagaaattcccacgccttacatgtggagctatcagccccaaatgggactggcagcaggcgcctcccaggactactccacccgcatgaattggctcagcgccggcccctcgatgatctcacgggttaatgatatacgagcttaccgaaaccagttactcctagaacagtcagctctcaccaccacaccccgccaacaccttaatccccggaattggcccgccgccctggtgtaccaggaaactcccgctcccaccaccgtactacttcctcgagacgcccaggccgaagttcagatgactaacgcaggtgtacagctggcgggcggttccgccctgtgtcgtcaccggcctcagcagagtataaaacgcctggtgatcagaggccgaggtatccagctcaacgacgagtcggtgagctcttcgcttggtctgcgaccagacggagtcttccagatcgccggctgtgggagatcttccttcactcctcgtcaggctgtcctgactttggagagttcgtcctcgcagccccgctcgggcggcatcgggactctccagtttgtggaggagtttactccctctgtctacttcaaccctttctccggctctcctggccagtacccggacgagttcataccgaacttcgacgcaatcagcgagtcagtggatggctatgattgatgtctggtggcgcggctgagttagctcgactgcgacatctagaccactgccgccgctttcgctgtttcgcccgggaactcaccgagttcatctacttcgaactccccgaggagcaccctcagggaccggcccacggagtgcggattaccattgaagggggaatagactctcgcctgcatcggatcttctgccagcgacccgtgctgatcgagcgcgaccagggaactacaacagtctccatctactgcatctgtaaccaccccggattgcatgaaagcctttgctgtcttatttgtgctgagtttaataaaaactgagttcagaccctcctacggactaccgcttcttcaacccggactttacaacaccagccagaccctccgttccagccagaagacccagacccttcctctgatccaggactctaattctacctccccagcaccttttcctactaaccttcccgttactaacaacctcggagctcagctgcaacaccgcttctccagaagcctcctttctgccaatactactactcccagaaccggaggtgagctccgtggtctccctactgacaacccctgggtggtagcgggttttgtagcgctaggagtagttgcgggtgggttggtgcttatcctctgctacctatacacaccttgctgtgcttatttagtagtattgtgttgctggtttaaaaaatgggggtcgtactagtagcgctcgctttactttcgcttttgggtctgggctctgctaatcttcctcccgatcacgatccatgtctggactttgatccagagaactgcacacttacttttgcacctgaaacaagtcgctactgcggagttcttattaggtgcggacgggaatgcaggcccattgagattacacacaataacaaaacttggaacaataccttatttaccacatggtctccaggagatcctcagtggtatactgtctctgtccggggtcctgacggttccgtccgcatggctaataacactttcatttttgctgaaatgtgcgatatggtcatgttcatgagcagacagtatgacctatggcctcccagcaaagagaacattgtggcattctccattgcttattgcttgggtacatgcatcatcactgctatcatgtgtgtgtgcatacacttgcttgtaatcattagacctaggaataacaatatcaaagaaaaaatgccctaatctttttcaaaactttgttttcagccatgattactgtcacaactatttttgctattgctagcattgcatcagctcaaataacaacacctattagacacaccatttacacaggtcaaaactatacattgtgggtcccaaaaaactattcaaatgttctatggatatactacacaggatcatggcaaaccagccagatgctttgcgaagggtccaaagtttcatacccagagcttaaacacaattgtactgacacaaacctgacacttattaatgttaatgcaagctatactgcagactactatgcttacaacaaatcatattctaacacaataatatacaaaattaaagtgcaaaacttaaccacaccgcagccaccaaaaccaaccacaactattgtaatcacaactaccaaatccaaaaaacctgctaaaacaagctacaagccaggaatttttgaaacattgtttttgagtaggcaaatctctgatcattttgaaaattcaacactagcagatgaaacgcaaattcctgtttctatgattgggataatcacagcagtggtggtcgggttggtgattattattatttgtatgatcacctatgcttgctgctacaggaagtttcatcatgaaaaagttgatccactactaaattttgatttttaattttttttctttagctcaatgggtgctttttcaattttaatttttctttcaactatcaaatttactgtagaactttcttttataaaaaatgttactgtatcagaaggacaaaatataacattagtcgggattaacaccactgacactaaaagaatcacttctaacataacttgggaaactcaagtaggtactagaagacaaaatgtatgtaatttaaaccttacaaaatacatctgtgaaggtgttaatcttaccattattaactgcactgaacatgactctaaaccattctatggagaatcttacactacacaaaaaaagggttacacacaaggatacttcattcacaattatgcggtgtattatttaaaagttatcatgtccactacaccagccactactgccactactgtcacagtaattacattgacaaccaaaagtatgcttcgccctaaagctgaagccttaaatttcttaactaatgtgcagactgctgaaacacatgctacctcaaatccttatcttaccacaaacgctactgtcgcctcgcttgttacacccttaaaacatatatcagtttctttgcaactacaaatcacttttctcattgtagtgggaataaccattcttgcagtgttgctttactatatcttttgccgccaaatacccaacgttcaaaggcgacctatatataggcctatcataggagaaccccaacaacttcaggtggagggaggtctaagaaatcttatgttctcttttacagtatggtgatcaccaatcatgatccctagaaatttcttcttcaccatactcatctgtgctttcaatgtctgtgctaccttcacagcagtagctactgcaaccccagactgtataggagcatttgcctcctatgcactttttgccttcgttacttgcatctgcgtgtgtagcatagtttgcctggttattaattttttccaacttgtagactggatctttgtgcgcattgcctacctgcggcaccaccccgaataccgcaatcaaaatgttgcggcacttctcaggcttatctaaaaccatgcaggctatgctaccagtcattctgattctgctgctcccctgcgttgccttagctcccatcactcgtaccccacatgaacaacttagaaaatgcaaatttcaacagccatggtcattccttgattgctaccaagaaaaatctgattttcccacatactggatagtgattgttggaataattaacatactctcatgcactttattctccttcctaatataccccatatttaattttgggtggaatgttcccaatgcacttggttacccacaaaatccagaggaacacattccactacagaacatgcaacagccactagacctaatagattatgaaaatgagccacagcctccactactccctgccattagctacttcaacctaaccggtggagatgactgacccactcgccgcctccactgctgacaaggaactacttgatatggacggccgtgcctccgaacagcgactcacccaactacgaattcgccagcagcaggaacgtgccgccaaggagctcagggatgctattgagattcaccagtgcaaaaaaggcatattctgcttagtaaaacaagccaagatctcatacgagattaccgctaacgaccaccgcctctcatatgagcttggtccgcaacgtcagaaattcacttgcatggtgggaatcaaccccatagtcatcacccagcaagctggagataccaagggttgcatccattgttcctgtgaatccaccgagtgcatctacaccctgctgaagaccctttgcggccttcgagaccttctacccatgaactaatcaaccccgcccttcccttaccaattacataaagccaattaataaaaaatcacttacttaaaatcagaaataaggtttttgtctgcgttgttttcgagcagcacctcacttccctcttcccaactttggtactctaaacctcggcgggtggcatacttcctccacactttgaaagggatgtcaaattttagttcctcttctttgcccacaatcttcatttctttatccccagatggccaaacgagctcggctaagcagctccttcaatccggtctacccctatgaagacgagagcagctcgcaacacccatttataaaccctggcttcatttcccctaatgggtttacacaaagtcaagacggggctcttacactcaagtgtgttgcacctcttactaccaccagtggctccctagacattaaagtaggaggggggcttagagtagaccccactgatggatcattggaagaagacacaaaagtcaatgcccctttatccaaaacaaaccactccataagtcttgaaactgggaatgggctggaactgcaaaacagtcagctttgtgcaaaactgggagagggactaaaattcaacttaaacaaaatctgcgtagactatgacattaatactctttggacaggagtaaaccccaacaccaattgtcaaatgttagatgacagcgaatccaatgattgtaaactaacttttatactaaacaaaaacggagcgcttgttaatgcttatgtatcagtggttggtgtaaccgacctattcaatattcttactacccaaaaatccataatttttaatgcccaactgtattttgattctgatggcaatttaattactgacttatcgtcccttaaaaccccattaaatcataagacgggacaacaaatgtctactagtgttttaacaaatgccaaaagtttcatgcccagcattgctgcttatccatttaataacaatgacagggccaaagaaaattacatttatggaacttgttattataaagcattagacaacactctctacccaatggacgtatctgttatgctcaacaggcgagcaatgactgctactacagcttattgcataagcattacatggtcatggaatgtaggaacagctccagaaacaaccacaaccaccctggtcacctcccccttttacttttcctacattagagaagatgactgacaacaaaaataaagtttaactttttattgaaaatcagtttacaggattcgagtagttattttgcctcccccttcccattttatagaatacaccaatctctccccacgcacagctttaaacatttggattccatttgagatagtcatggatttagattccacattccacacagtttcagagctagataatcttggatcagtgatagatataaatccatcggggcagtccttcaaggtgatttcacagtccagttgctgtggctgcggctccggagtctggatcagagtcatctggaagaagaacgatgggagtcataatccgagaacgggatcgggcggttgtgtctcatcaaaccccgaagcagtcgctgtctgcgccgctccgtgcgactgctgctgatgggatcggggtccacagtctctcgaagcatgattctaatagccctcaacattaacattctggtacgatgcgcacagcaacgcatcctgatctcacttaggtcacagcagtaggtacaacacaacaccacaatgttgtttaacaggccataattaaaggcgctccagccaaaactcatttcaggaataatttgcccagcgtggccatcgtaccaaatcctgatgtaaatcaaatggcgccccctccagaacacactgcccacatacatgatctccttaggcatatgcatattcacaatctctcggtaccatggacagcgctggttaatcatgcagccccaaataatcttccggaaccaaatggccagcactgcgcccccagcaatacattgaagagaaccctgtcgattacagtgacaatggagaacccacttctctcgcccatggatcacttgggaataaaatatatctattgtggcacaacacagacataaatgcatacatcttctcatcacccttaactcttcaggggttaaaaacatatcccagggaataggaagctcttgcaaaacagtgaaggtggcagaacaaggcagaccgcgaacataacttacactgtgcatggtcaaggtattgcaatctggtaacagcggatgctcctcagtcatagaagctctggtttcactttcctcacaacgtggtaaaggggccctcagttgagggtccctggtgtaaggatggtgtctggcgcacgatgtcgagcgtgcctgcgacctcgttgtaatggagcttcttcctgacattctcgtattttgcaaagcagaacctagtcttggcacagcacacgtcccgtcgcctcctgtcccgccgcctagcacgttcagtgtggtaattatagtacagccattcccgtagattggtcaaaagatcttcagcctcagttgtcataaaaactccatcatatcttactgctctgataaaatcattcactgtagaaagtgcaatgcccagccaggcaatgcaattagcttgtgtttcgaccaaaggagggggaggaagacatggaagaaccataattaatttttatgccagacgatcccgcagtatttctatatggagatcacggagatggcacctctcgcccccactgtgttgatgaaaaatgacagctaggtcaaacataatgcgattttccaggtgctcaacggtggcttcaagcaaagcctccaaacgtacatccaaaaacaaaagaacagcaaaagcaggagcattttctaattcctcaatcatcatattacattcctgtaccattcccaaataattttcatctttccatccttgaattattcgtgttatttcatctggtaaatccaatccacacatgagaaatagctcccggagggcgccctccaccggcaatcttaagcataccctcatagtgacaaaatatcgtgctcctctgtcacctgcagcaaattgagaatggcaacatcaaacggaatgccactggctctaagttcttctctaagttccagttgtaaaaactcttgcatatcatcgccaaactgcttagccataggtcctccaggaataagagcgggggacgctacagtgcagaacaagcgcatgccgccccaattgcctccagcaaaagtgaggttgcaatatgcatactgagaacctccagtgatatcatccagtgtactggaaagataatcaggcagagcttctcgtatgcaattaataatagaaaagtctgccagatgcacatttaaagcctgtgggatgcagatgcaataagttatcgcgctgcgctccaacattgttagtatggttagtctgtaaaaacaaaaaacaaaaaaaattacatcacgctgtactggcgaacgggtggataaatcactctctccatcaccaggcaggctacagggtctccagcgcgaccctcgtaaaacctatcagtatgattaaaaagcatcaccgaaaggggttgttgatggccagcatatattatttgcgatgaagcatacaaaccagaagtgttagtatcagttaaggaaaaaaatctgccaagatagcatctcggaacgattatgctcaatctcaaatgtagcaaagcgacaccacgcggatgcaaagtaaaatccacaggagcataaaaaaagtaattattcccctcttgcacaggcagcctagctcccggtccctccaaaatcacatacaaagcttcagcagccatagcttaccgcgcaaatcaggcacagcagtcagataaagagaaagctgtgaactgactgcccagcctgtgcgcaatatatagagaacccttacactgacgtaattggacaaagtctaaaaaaacccgccaaaaaaccagcacacgcccagaagtgtgtcacccgctaaaaaaaataattttcacttcctcgttccgtatatgacgtcaattcctctttcccacgaatcgtcacttccggacatcttgcaacgtcacctccccgcgccggcccgccccttttgaccgttgaacccgctggccaatccccttccgccctccattttcaaaagctcatttgcatgttggcaccgttccatttataaggtatattattgatgatg

SEQ ID NO: 2 - protein, 212 aa, Ape adenovirus AH34
MITVTTIFAIASIASAQITTPIRHTIYTGQNYTLWVPKNYSNVLWIYYTGSWQTSQMLCEGSKVSYPELKHNCTDTNLTLINVNASYTADYYAYNKSYSNTIIYKIKVQNLTTPQPPKPTTTIVITTTKSKKPAKTSYKPGIFETLFLSRQISDHFENSTLADETQIPVSMIGIITAVVVGLVIIIICMITYACCYRKFHHEKVDPLLNFDF

SEQ ID NO: 3 - protein, 832 aa, Ape adenovirus AH34
METQPSLPTPLQAPSHLAPSSDEEEQSLTTPPPSPATTTSTLDEEEEVDAPQEMQDMEDEKAEEIEADVEQDPGYVTPAEHEEELRRFLDREDNNRPEQQADGDHQEAGLGDHVAEYLTGLGGEDVLLKHLARQSIIVKDALLDRTEVPISVEELSRAYELNLFSPRVPPKRQPNGTCEPNPRLNFYPAFAVPEVLATYHIFFKNQKIPVSCRANRTRADALLNLGPGARLPDIASLEEVPKIFEGLGSDETRAANALQQGENGMDEHHSALVELEGDNARLAVLKRSIEVTHFAYPAVNLPPKVMSAVMDQLLIKRASPLSEDQNMQDPDASDEGKPVVSDEQLSRWLATNSPRDLEERRKLMMAVVLVTVELECLRRFFTDPETLRKLEENLHYTFRHGFVRQACKISNVELTNLVSYMGILHENRLGQSVLHTTLKGEARRDYIRDCVYLYLCHTWQTGMGVWQQCLEEQNLKELDKLLQRSLKALWTGFDERTVASDLADIIFPERLRVTLRNGLPDFMSQSMLNNFRSFILERSGILPATCCALPSDFVPLTYRECPPPLWSHCYLFRLANYLSYHSDVIEDVSGDGLLECHCRCNLCTPHRSLACNPQLLSETQIIGTFELQGPSSEGEGSSPGQSLKLTPGLWTSAYLRKFAPEDYHPYEIRFYEDQSQPPKTELSACVITQGAILAQLQAIQKSRQEFLLKKGNGVYLDPQTGEELNTRFPQDVPAPRKQEVEGAAAAPRGYGGRLGQSGRGGGDGRLGQPGRGGGQPGGRQFGGGRRGGRGGGRNNRRQTVVLGSGDKQGPRQQQQHGYNLRSGSGGPAASQQ

SEQ ID NO: 4 - protein, 205 aa, Ape adenovirus AH34
MSQRRGSKKLKVQLPPPEDMEEDWDSQAEEEEMEDWDSQAEEADSLEEDSLEEEDEEAEEVEETTAAKQLSSAAETSKVPDSSSSTATISAPGRGAQRRPNSRWDETGRFPNPTTASKTGKKERQGYKSWRGHKNAIISCLHECGGNISFTRRYLLFHHGVNFPRNVLHYYRHLHSPYYSQQVPAASAEKDSSSGDLQQKTSSSS

SEQ ID NO: 5 - protein, 238 aa, Ape adenovirus AH34
MSQRRGSKKLKVQLPPPEDMEEDWDSQAEEEEMEDWDSQAEEADSLEEDSLEEEDEEAEEVEETTAAKQLSSAAETSKVPDSSSSTATISAPGRGAQRRPNSRWDETGRFPNPTTVTSTAPTTASKSRQPRQRKTAAAGTSSRKPAAAVRKSSAAGGGLRITANEPAQTRELRNRIFPTLYAIFQQSRGQEQELKVKNRSLRSLTRSCLYHKSEDQLQRTLEDAEALFNKYCALTLKE

SEQ ID NO: 6 - protein, 389 aa, Ape adenovirus AH34
MHPVLRQMRPQQQAPSQQQQQPQKALPAPAPATTAVAAVCGAGQPAYDLDLEEGEGLARLGAPSPERHPRVQLKKDSREAYVPQQNLFRDRSGEEPEEMRASRFNAGRELRHGLDRRRVLRDEDFEVDEVTGISPARAHVAAANLVSAYEQTVKEERNFQKSFNNHVRTLIAREEVTLGLMHLWDLMEAITQNPTSKPLTAQLFLVVQHSRDNEAFREALLNITEPEGRWLYDLINILQSIIVQERSLGLAEKVAAINYSVLSLGKYYARKIYKTPYVPIDKEVKIDGFYMRMTLKVLTLSDDLGVYRNDRMHRAVSASRRRELSDRELMHSLQRALTGAGTEGENYFDMGADLQWQPSRRALDAAGCELPYIEEVDEGEEEEGEYLED

SEQ ID NO: 7 - protein, 520 aa, Ape adenovirus AH34
MASRGGNQSSDRHREHTPERGRGSASHPPPRPDRSPSQSPPPLPPKRNTYRRVGSGSSTESQVVLVSETSRSSLSPERSNSPPPIPPKKKPRKTKHVPLQDISQDSEEEREQAELVAVGFSYPPVRITEKDGKRSVEKIDKNDPLAKGAAAASSIAVRNPMSLPLVSAWEKGMEVMAVLMERYRLDNDLRTSFKLMPEQHEQYRRICHQYVNEEHRGIPLTFTSMKTLTTMMGRFLQGLAHSYSEIAHNNWECTGCALWAHGCTDYEGKVKCLHGTIMIQKDHIIEMDVASENGQRAMKENPDRAKITQNRWGRNVVQLANNDARCCVNDANCATNQFSSKSCGMFYTEGSKAQEAFKQYEAFMKAVYPGITPDQARMMLIPIHCDCNHKPGCAPVMGRQTCKMTPFGMANAEDLDVTTISDPTVLASVRHPALMVFQCCNPVYRNSRAQNAGPNCDFKISAPDLLGALQLTRKLWQDTFPEILVPKLVIPEFKWQNRFQFRNVSLPAGHADSRQNPFDF

SEQ ID NO: 8 - protein, 181 aa, Ape adenovirus AH34
MEVWAILEDLRQTRQLLENASDGVSSLWRFWFGGDLARLVFRVKREYSEEFEKLLEDSPGLFEALNLGHQAHFKEKVLSVLDFSTPGRTAAAVAFLTFILDKWIPQTHFSKGYVLDFIAAALWRTWKARRLRIILDYWPVQPLGVAAILRHPPAMPAVLEEEQQEDNPRAGLDPPVEEAEE

SEQ ID NO: 9 - protein, 495 aa, Ape adenovirus AH34
MDPTNPLQQGIRLGFHSSSFVENMEGPQAEDNLRLLASAASGRSGNPETPTGHASGSGGGAAGGQPESRPGPSGGGGGGVADLFPELRRVLTRSTSSGQDRGIKRERNASGHNSRTELALSLMSRSRPETIWWHEVQSEGRDEVSILQEKYSLEQIKTCWLEPEDDWEVAIRNYAKISLRPDKQYRITKKINIRNACYISGNGAEVIIDTPDKTAFRCCMMGMWPGVAGMEAVTLMNIRFRGDGYNGIVFMANTKLILHGCSFFGFNNTCVEAWGQVSVRGCSFYAGWIALSGRTKSQLSVKKCMFERCNLGILNEGEARVRHCAATETGCFILIKGNASVKHNMICGPSDERPYQMLTCAGGHCNMLATVHIVSHARKKWPVFEHNVMTKCTMHAGGRRGMFMPYQCNMNHVKVMLEPDAFSRMSLTGIFDMNVQLWKILRYDETKSRVRACECGGKHARFQPVCVDVTEDLRPDHLVLACTGAEFGSSGEETD

SEQ ID NO: 10 - protein, 105 aa, Ape adenovirus AH34
MSGGAAELARLRHLDHCRRFRCFARELTEFIYFELPEEHPQGPAHGVRITIEGGIDSRLHRIFCQRPVLIERDQGTTTVSIYCICNHPGLHESLCCLICAEFNKN

SEQ ID NO: 11 - protein, 135 aa, Ape adenovirus AH34
MTDPLAASTADKELLDMDGRASEQRLTQLRIRQQQERAAKELRDAIEIHQCKKGIFCLVKQAKISYEITANDHRLSYELGPQRQKFTCMVGINPIVITQQAGDTKGCIHCSCESTECIYTLLKTLCGLRDLLPMN

SEQ ID NO: 12 - protein, 148 aa, Ape adenovirus AH34
MKAFAVLFVLSLIKTEFRPSYGLPLLQPGLYNTSQTLRSSQKTQTLPLIQDSNSTSPAPFPTNLPVTNNLGAQLQHRFSRSLLSANTTTPRTGGELRGLPTDNPWVVAGFVALGVVAGGLVLILCYLYTPCCAYLVVLCCWFKKWGSY

SEQ ID NO: 13 - protein, 251 aa, Ape adenovirus AH34
MGAFSILIFLSTIKFTVELSFIKNVTVSEGQNITLVGINTTDTKRITSNITWETQVGTRRQNVCNLNLTKYICEGVNLTIINCTEHDSKPFYGESYTTQKKGYTQGYFIHNYAVYYLKVIMSTTPATTATTVTVITLTTKSMLRPKAEALNFLTNVQTAETHATSNPYLTTNATVASLVTPLKHISVSLQLQITFLIVVGITILAVLLYYIFCRQIPNVQRRPIYRPIIGEPQQLQVEGGLRNLMFSFTVW

SEQ ID NO: 14 - protein, 170 aa, Ape adenovirus AH34
MGVVLVALALLSLLGLGSANLPPDHDPCLDFDPENCTLTFAPETSRYCGVLIRCGRECRPIEITHNNKTWNNTLFTTWSPGDPQWYTVSVRGPDGSVRMANNTFIFAEMCDMVMFMSRQYDLWPPSKENIVAFSIAYCLGTCIITAIMCVCIHLLVIIRPRNNNIKEKMP

SEQ ID NO: 15 - protein, 124 aa, Ape adenovirus AH34
MAAEALYVILEGPGARLPVQEGNNYFFYAPVDFTLHPRGVALLHLRLSIIVPRCYLGRFFSLTDTNTSGLYASSQIIYAGHQQPLSVMLFNHTDRFYEGRAGDPVACLVMERVIYPPVRQYSVM

SEQ ID NO: 16 - protein, 91 aa, Ape adenovirus AH34
MIPRNFFFTILICAFNVCATFTAVATATPDCIGAFASYALFAFVTCICVCSIVCLVINFFQLVDWIFVRIAYLRHHPEYRNQNVAALLRLI

SEQ ID NO: 17 - protein, 133 aa, Ape adenovirus AH34
MQAMLPVILILLLPCVALAPITRTPHEQLRKCKFQQPWSFLDCYQEKSDFPTYWIVIVGIINILSCTLFSFLIYPIFNFGWNVPNALGYPQNPEEHIPLQNMQQPLDLIDYENEPQPPLLPAISYFNLTGGDD

SEQ ID NO: 18 - protein, 304 aa, Ape adenovirus AH34
MSGRSSITTRSQARSTSCARHHPYTRDPQLRAPLPRCEESETRASMTEEHPLLPDCNTLTMHSVSYVRGLPCSATFTVLQELPIPWDMFLTPEELRVMRRCMHLCLCCATIDIFYSQVIHGREKWVLHCHCNRQGSLQCIAGGAVLAIWFRKIIWGCMINQRCPWYREIVNMHMPKEIMYVGSVFWRGRHLIYIRIWYDGHAGQIIPEMSFGWSAFNYGLLNNIVVLCCTYCCDLSEIRMRCCAHRTRMLMLRAIRIMLRETVDPDPISSSRTERRRQRLLRGLMRHNRPIPFSDYDSHRSSSR

SEQ ID NO: 19 - protein, 129 aa, Ape adenovirus AH34
MLERSAITYCICIPQALNVHLADFSIINCIREALPDYLSSTLDDITGGSQYAYCNLTFAGGNWGGMRLFCTVASPALIPGGPMAKQFGDDMQEFLQLELREELRASGIPFDVAILNLLQVTEEHDILSL

SEQ ID NO: 20 - protein, 117 aa, Ape adenovirus AH34
MRVCLRLPVEGALRELFLMCGLDLPDEITRIIQGWKDENYLGMVQECNMMIEELENAPAFAVLLFLDVRLEALLEATVEHLENRIMFDLAVIFHQHSGGERCHLRDLHIEILRDRLA

SEQ ID NO: 21 - protein, 127 aa, Ape adenovirus AH34
MVLPCLPPPPLVETQANCIAWLGIALSTVNDFIRAVRYDGVFMTTEAEDLLTNLREWLYYNYHTERARRRDRRRRDVCCAKTRFCFAKYENVRKKLHYNEVAGTLDIVRQTPSLHQGPSTEGPFTTL

SEQ ID NO: 22 - protein, 322 aa, Ape adenovirus AH34
MAKRARLSSSFNPVYPYEDESSSQHPFINPGFISPNGFTQSQDGALTLKCVAPLTTTSGSLDIKVGGGLRVDPTDGSLEEDTKVNAPLSKTNHSISLETGNGLELQNSQLCAKLGEGLKFNLNKICVDYDINTLWTGVNPNTNCQMLDDSESNDCKLTFILNKNGALVNAYVSVVGVTDLFNILTTQKSIIFNAQLYFDSDGNLITDLSSLKTPLNHKTGQQMSTSVLTNAKSFMPSIAAYPFNNNDRAKENYIYGTCYYKALDNTLYPMDVSVMLNRRAMTATTAYCISITWSWNVGTAPETTTTTLVTSPFYFSYIREDD

SEQ ID NO: 23 - protein, 958 aa, Ape adenovirus AH34
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGTAYNSLAPKGAPNTCQWIAKGAPVTDQANQDDGENEEQELTDVTYAFGNAPVQAEAKITKDGLPVGLEITEDEQKPIYADKLYQPEPQIGDEQWHDTTGTNEQYGGRALKPATNMKPCYGSFARPTNKKGGQAKTRKIEKEENGVKTVTEEADIDMDFYDLRSQRANYDPKIVLYSENVNLETPDTHIVYKPGTDETSSSTNLGQQAMPNRPNYIGFRDNFVGLMFYNSTGNMGVLAGQASQLNAVVDLQDRNTELSYQLLLDSLGDRTRYFSMWNQAVDSYDPDVRIIENHGVEDELPNYCFPLDGVGPITGTYQGVEPDDGNNGNWKKNTKVNGANEIGKGNNYAMEINLQANLWRSFLYSNVALYLPDGYKYTPANVTLPENKNTYGYINGRVVSPSLVDSYINIGARWSLDLMDNVNPFNHHRNAGLRYRSMLLGNGRYVPFHIQVPQKFFAIKNLLLLPGSYTYEWNFRKDVNMVLQSSLGNDLRVDGASISFTSINLYATFFPMAHNTASTLEAMLRNDTNDQSFNDYLSAANMLYPIPANATNIPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYIPEGYKDRMYSFFRNFQPMSRQVVDEVNYKEYQAVTLAYQHNNSGFVGYHAPTLRQGQPYPANYPYPLIGTTAVTSVTQKKFLCDRTMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 24 - protein, 448 aa, Ape adenovirus AH34
METKGRRSATVLDQQDEPEAHPRKRPTRRAPIHRDGNNPDSDAATLERSDPGSAGRPSSDTILQEPPQPAKRGGLLDRDAIEHITELWDRLELLQQTLSKMPMADGLKPLKNFSSLQELLSLGGERLLTDLVRENIHVREMMNEVAPLLREDGSCRSLNYHLQPVIGVIYGPTGCGKSQLLRNLLSSQLITPAPETVFFIAPQVDMIPPSELKAWEMQICEGNYAPGPEGTFIPQSGTLRPKFIKMAYDDLTQEHNYDVSDPRNVFARAAAHGPIAIIMDECMENLGGHKGVSKFFHAFPSKLHDKFPKCTGYTVLVVLHNMNPRRDLGGNIANLKIQSKMHIISPRMHPSQLNRFVNTYTKGLPVAISLLLKDIVQHHALRPCYDWVIYNTTPEHEALQWSYLHPRDGLMPMYLNIQSHLYRVLEKIHRVLNDRDRWSRAYRARKIK

SEQ ID NO: 25 - protein, 138 aa, Ape adenovirus AH34
MSGSASFEGGVFSPYLTGRLPPWAGVRQNVMGSTVDGRPVQPANSSTLTYATLSSSSLDAAAAAAASAAANTVLGMGYYGSIVANSSSSNNPSTLAEDKLLVLLAQLEALTQRLGELSQQVAQLREQTESAVATAKSK

SEQ ID NO: 26 - protein, 584 aa, Ape adenovirus AH34
MMRRAVLGGAVVYPEGPPPSYESVMQQQAAAVMQPSLEAPFVPPRYLAPTEGRNSIRYSELAPQYDTTRLYLVDNKSADIASLNYQNDHSNFLTTVVQNNDFTPTEASTQTINFDERSRWGGQLKTIMHTNMPNVNEYMFSNKFKARVMVSRKKPEGYTGDENDTSQDILEYEWFEFTLPEGNFSATMTIDLMNNAIIDNYLAVGRQNGVLQSDIGVKFDTRNFRLGWDPVTKLVMPGVYTYEAFHPDIVLLPDCGVDFTESRLSNLLGIRKRHPFQEGFKIMYEDLEGGNIPALLDVQAYEESKKANAGTTTTTTTTEVTTVAVANALTTSAKAVANVTVDAITEANNNAIRGDNYLPANAMKESGETTVVPVIPIPETQTETETETKEPTIKPLEKDTKDRSYNVISGTNDTAYRSWYLAYNYGDPEKGVRSWTLLTTSDVTCGAEQVYWSLPDMMQDPVTFRSTRQVSNYPVVGAELMPVFSKSFYNEQAVYSQQLRQTTSLTHIFDRFPENQILIRPPAPTITTVSENVPALTDHGTLPLRSSIRGVQRVTVTDARRRTCPYVYKALGIVAPRVLSSRTF

SEQ ID NO: 27 - protein, 587 aa, Ape adenovirus AH34
MEQQAPDPAMRAALQSQPSGINSSDDWTQAMQRIMALTTRNPEAFRQQPQANRLSAILEAVVPSRSNPTHEKVLAIVNALVENKAIRPDEAGLVYNALLERVARYNSSNVQTNLDRMVTDVREAVSQRERFQRDANLGSLVALNAFLSTQPANVPRGQQDYTNFLSALRLMVTEVPQSEVYQSGPDYFFQTSRQGLQTVNLSQAFKNLRGLWGVHAPVGDRATVSSLLTPNSRLLLLLVSPFTDSGSIDRNSYLGYLLNLYREAIGQSQVDEQTYQEITQVSRALGQEDTGSLEATLNFLLTNRSQKIPPQYALTAEEERILRYVQQSVGLFLMQEGATPSAALDMTARNMEPSMYASNRPFINKLLDYLHRAAAMNSDYFTNAILNPHWLPPPGFYTGEYDMPDPNDGFLWDDVDSSIFSPPPGYNTWKKEGGDRRHSSVSLSGSRGAAAAVPEAASPFPSLPFSLNSVRSSELGRITRPRLMGEDEYLNDSLLRPEREKNFPNNGIESLVDKMSRWKTYAQDHKDEPRILGAASGTTRRRQRHDRQRGLVWDDEDSADDSSVLDLGGRGGGNPFAHLRPHFGRML

SEQ ID NO: 28 - protein, 1194 aa, Ape adenovirus AH34
MALVQAHGSGSFHPEASDPGRQPPRRRARKSSQGAVPEPTRARRRRASTSHAAGARATPTARRAPSPPLLNMQEATEPPPPPKRKNKGTVVAPKGHGTLQAIDITTNGPVEIKYHLNLPHALEKIMQVNLLTLPTNLTPQRLRTLDSSGLRALVLELRPSRAEVWTCLPRGLVSMTTIETEDGQADADNIVEREVQAPGLNFPLKFLVKGSQVQLIHEVHPVKRCEYCGRLYKHKHECSARRREFYFHHINSHSSNWWQEIQFFPIGSHPRTERLFLTYDVETYTWMGSFGKQLIPFMLVMKLSGDERLVNIAYDLAMKLKWDRWQQDPKTFYCITPEKMAVGQHFRQYRDQLQTALAVDLWSSFLTANPHLHEWALEHYALSDPTDLTFEELKKLPHVRGTPRFIELYIVGHNINGFDEIVLAAQVINNRAEVPQPFRITRNFMPRAGKILFNDVTFALPNPAYKKRVDFQLWEQGACDDIDFKYQFLKVMVRDTFALTHTSLRKAAQAYSLPVEKGCCPYKAVNQFYMLGSYRADKDGFPLEEYWKDREEYLLNRELWEKKNQPGYDIIQETLDYCALDVLVTAELVAKLQESYAHFIRDSVGLPHAHFNIFQRPTISSNSHAIFRQIVYRAEKPNRTNLGSGLLAPSHELYDYVRASIRGGRCYPTYIGILEEPLYVYDICGMYASALTHPMPWGTPLNPYERALAAREWQMALDDPTPISYFDKDLLPGIFTMDADPPDELMLDPLPPFCSRKGGRLCWTNEPLRGEVTTSVDLITLHNRGWRVRIVPDELTTIFPEWKCLAREYVQLNIAAKERADKEKNQTMRSIAKLLSNALYGSFATKLDNKKIVFSDQMDESLMKGISAGTVNIKSSSFLETDNLSAEVMPAFEREYLPQQLALLDSDPEDSEDEQRPAPFYTPPAGTPGHVAYTYKPITFLDVEEGDMCLHTVEKVDPLVDNDRYPSHVASFVLAWTRAFVSEWSEFLYEEDRGTPLEDRPIKSVYGDTDSLFVTQRGHELMETKGKKRIKKHGGKLVFDPDEPDLTWLVECETVCASCGADAYSPESIFLAPKLYALKCLYCPVCQKTSKGKLRAKGHAAEALNYELMVNCYLADMQGADRQRFSTSRMSLKRTLASAQPGAHPFTVTETTLTRTLRPWKDRTLAALDAHRLIPYSRSRPNPRNEEVCWIEMP

SEQ ID NO: 29 - protein, 209 aa, Ape adenovirus AH34
MACGSGNGSSEQELRAIARDLGCGPYFLGTFDKRFPGFMDPDKLACAIVNTAGRETGGEHWLAFGWNPRSNTCYLFDPFGFSDERLKQIYQFEYEGLLRRSALATKDRCITLEKSTQTVQGPRSAACGLFCCMFLHAFVHWPDRPMDGNPTMKLLTGVPNSMLQSPQVQPTLRHNQEALYRFLNTHSSYFRSHRARIEKATAFDRMDMQ

SEQ ID NO: 30 - protein, 662 aa, Ape adenovirus AH34
MALSINDCARLTGQTVPTMNYFMPLRNIWNRVREFPRASTTASGITWMSRYIYGYHRLMLEDLAPGAPATERWPLYRQPPPHFLIGYQYLVRTCNDYIFDTRAYSRLKYTEIVRPGHQTVNWSVMANCSYTINTGAYHRFVDFDDFQATLTQVQQAILAERVVADLALVQPMRGFGLTRMHGRAGEEEVPVERLMQDYYKDLARCQDNAWGMADRLRIQQAGPKDLVLLATIRRLRTAYFNFITSSIVSPSRDDEEGEGRENPDRASSHPRPQETVLSLPCDCDWLDAFVERFSDPVDLQTIRSLRGVPTGQLIKCIISALSLPNGEPPSHHFREMRGGVFTLRPRENGRAVTETMRRRRGEVIERFIDRLPVRRRRRRAPPPPPPPPEEEEEMLVEEEIEEEEEEIPGAFEREVRATIADLIRLLEEELTVSARNSQFFNFAVDFYEAMERLEALGDVSEMPLRRWIMYFFVTEHIATTLNYLFQRLCNYAVFTRHVELNLAQVVMRARDPEGAVVYSRVWNEAGMNAFSQLMGRISNDLAATVERAGRGDLQEEEIEQFMAEIAYQDNSGDVQEILRQAAVNDTEIDSVELSFRFKLTGPVAFTQRRQIQDVNRRVVAHASLLRAQYQNLPARGADVPLPAMPPGPEPPLPPGARPRHRF

SEQ ID NO: 31 - protein, 250 aa, Ape adenovirus AH34
MEDINFSSLAPRHGTRPYMGTWSDIGTSQLNGGAFNWSSIWSGLKNFGSTIKTYGNKAWNSSTGQALRNKLKEQNFQQKVVDGIASGINGVVDLANQAVQKQINSRLDPPPAAPGEMEVEEELPPLEKRGDKRPRPDMEETLVTRGDEPPPYEEAIKLGMPTTRPIAPMATGVMKPSQSHRPATLDLPPAPAAAAPAPKPVATPKPTSVQPVAVARPRPGGTPRPNANWQSTLNSIVGLGVQSVKRRRCY

SEQ ID NO: 32 - protein, 192 aa, Ape adenovirus AH34
MSILISPSNNTGWGLRTPTRMYGGARKRSTQHPVRVRGHFRAPWGALKGRTRTRTTVDDVIDQVVADARNYTPAAPASTVDAVIDSVVADAREYARRKSRRRRIARRHRATPAMRAARALLRRAKRVGRRAMLRAARRAASGASAGRSRRRAATAAAAAIANMAQPRRGNVYWVRDATTGQRVPVRTRPPRT

SEQ ID NO: 33 - protein, 227 aa, Ape adenovirus AH34
MSKEIPTPYMWSYQPQMGLAAGASQDYSTRMNWLSAGPSMISRVNDIRAYRNQLLLEQSALTTTPRQHLNPRNWPAALVYQETPAPTTVLLPRDAQAEVQMTNAGVQLAGGSALCRHRPQQSIKRLVIRGRGIQLNDESVSSSLGLRPDGVFQIAGCGRSSFTPRQAVLTLESSSSQPRSGGIGTLQFVEEFTPSVYFNPFSGSPGQYPDEFIPNFDAISESVDGYD

SEQ ID NO: 34 - protein, 75 aa, Ape adenovirus AH34
MALTCRLRVPITGYRGRNSRRRRMLGSGMRRHRRRRATSRRLGGGFLTALIPIIAAAIGAVPGIASVAVQASQRH

SEQ ID NO: 35 - protein, 350 aa, Ape adenovirus AH34
MSKRKYKEEMLQVIAPEIYGPPVKDEKKPRKIKRVKKDKKEEDGDDGLVEFVREFAPRRRVQWRGRRVRPVLRPGTTVVFTPGERSSTTFKRSYDEVYGDDDILEQAADRLGEFAYGKRSRSSPKEEAVSIPLDHGNPTPSLKPVTLQQVLPVPPRRGVKREGEDLYPTMQLMVPKRQKLEDVLEKMKVDPDIQPEVKVRPIKQVAPGLGVQTVDIKIPTESMEVQTEPAKPTAASIEVQTDPWMPAPIATTASTARRPRRKYGPASLLMPNYALHPSIIPTPGYRGTRYYRSRSTTSRRRKTPASRSRRRRRRTTSKLTPAALVRRVYRDGRADPLMLPRARYHPSITT

SEQ ID NO: 36 - DNA, 35597 bp, Ape adenovirus BZ34
catcatcaataatataccttatagatggaacggtgccaatatgtaaatgaggtggtttgaaaatggagagcggaaggggattggctacggggtttaacggtcaaaaggggcggggcggcgcgggaaggtgacgtatgcgtgggtgtggctaagatgcaagctgtcgcggtatttctgacgtaaacgaggtggagtttaaacacggaagtatacagtttcccgcgcttattgacaggaaatgaggtagttttgggcggatgcaagtgaaaattcctcattttcgcgcgaaaactgaatgaggaagtgaatatctgagtaatttcgtgtttatgacagggtggagtatttaccgagggccgagtagactttgaccgattacgtggaggtttcgattaccgtgtttttcacctaaatttccgcgtacggtgtcaaagtcctgtgtttttacgtaggtgtcagctgatcgccagggtatttaaacctgacgagttccgtcaagaggccactcttgagtgccagcgagaagagttttctcctccgcgctgcgagtcagatctccacttcgaaaatgagacacctgcgtttcctgtcccaggagatagtctccactgaaactgggaatgaaatactgcagtttgtggtaaatactctgatgggagacgatccagagccgcctgagccatcttttgatcctcctacgcttcatgaattatatgatttagaggtagacggaccggaggaccctaatgaggacgacgtgaatgggttttttactgattctatgttattagctgctaatgagggagtggatttagacccaccttctggaactcttgatactccaggggtgattgtggaaagcgacataaatgggaaaaatttacctgatttgggtgctgctgaattggacttgcactgctatgaagagggttttcctccgagtgatgatgaagatgtggagaatgagcagtcaattcagaccgcagcgggtgagggagtgaaagcagccagtgatggttttaagttggactgcccgatgctgcctggacatggctgtaagtcttgtgaatttcacaggaaaaatactggagtaaaagaaatattatgctcgctttgttatatgagagcgcattgccactttatttacagtaagtgtgtttaagttaaatttaaaggaacagtagctgtttttataactcttggatgggtgatttatgttttgcttgtgattttttataggtcctgtgtctgatgctgatgaatcgccttctcctgattcaactacctcacctcctgaaattcaggcacccgtccctgcaaatgtatgcaagcccattcctgtgaagcttaagcctgggaaacgccctgctgtggataaacttgaggatttgctggagggtgtggatgaacctttggacttgtgtacccggaaaataccaaggcaatgagtgccccgcacctgtgtttatttaatgacgtcactatttatgtgagagtgccatgtaataaaattatgtcagctgctgagtgttttattgtttcttgggtgggacttgggatatataagtaggagcagacctgtgtggttagctcacagcagcttgcttccatccatggaggtttgggccatcttggaagatcttaggcagactaggcaactgctagaaaacgcctcggacggagtctctggtctttggagattctggttcggtggtgatctggctagactagtctttagaataaaacaggattacaggcaagaatttgaaaagttattggacgactgtccaggactttttgaagctcttaacttgggccaccaggctcattttaaggagaaggttttatcagttttggatttttctacccctggtagaactgctgctgctgtagctttccttacattcatatttgataaatggatcccacagacccacttcagcaagggatacgttttggatttcatagcagcagctttgtggagaacatggaaggctcgcaggatgaggacaatcttagattactggccagtacagcctctgggcgtagcagggatcctgagacacccaccgaccatgccagcggttttggaggaggagcaccaagaggacaatccgagagtcggcctggaccctccggtggaggaggcggaggagtagctgacttgtttcctgaactgcgacgggtgcttactagatctacaaccagtggacgggacaggggcattaagagggaaaggaatcctagtggaactaatcccagatctgagttggctttaagtttgatgagtcgcagacgtcctgaaactatatggtggcatgaggttcagaatgagggcagggatgaagtatcaatattgcaagagaaatattctctagaacaggtgaaaacatgttggttggagcctgaggatgattgggaggttgccattaggaattatgccaagatagctttgaggcctgataaattgtacagaattactaaacggattaatattagaaatgcatgttatatatcagggaatggggctgaggtagtgatagacactcaagacagaacagtttttagatgctgcatgatgggtatgtggccaggggtggttggcatggaggcagtaacccttatgaatgtaaagtttagaggggatgggtataatggtgtggtttttatggctaatactaaattgattttgcatggttgtagcttttttggttttaataatatatgtgtggaagcttgggggcaggtgagtgtaagaggctgtagtttctatgcatgctggattgcaacatcaggcaggaccaagagtcaattgtctgtaaagaaatgtatgtttgagagatgtaacctgggcatactgaatgaaggagaagccagagtcagccactgtgcttcttccgaaactggctgtttcatattgataaagggaaatgccaatgtgaaacataatatgatctgtggaccctcagatgagaggccttatcagatgctgacatgtgctggcggacattgcaatatgctggctaccgtgcatattgtttctcacccacgcaagaaatggcctgttttggaacataatgtgatgaccaaatgcactatgcacgtaggtggtcgcagaggaatgttaatgccataccagtgtaacatgaataatgtgaaagtgatgttggagccagatgcattttccagaatgagtttaacaggaatctttgacatgaatctgcaaatatggaagatcctgagatatgatgacacgaagtcgagggtacgcgcatgcgagtgcgggggcaaacatgccaggttccagccggtgtgtgtggatgtgactgaagaactaaggccagatcatttggtgattgcctgcactggagcggagttcggttctagtggtgaagaaactgactaaagtgagtagtagtgggatggtttggatggactctaatgtgaataagatggacagattgggtaaatttttgttttttctgtcttgcagctgtcatgagtggaagcgcttcttttgaggggggagtctttagcccttatctgacgggccgtctcccaccatgggcaggagtacgtcagaatgtcatgggatctactgtggatgggagaccagtccagcccgccaattcatcaacactgacctatgccactttgagctcttcacccttggatgcagctgcagctgctgccgcctctgctgccgccaacaccgtccttggaattggctattatggaagcatcgttgccaataccagttcctcaaataacccttcgaccctggctgaggacaagctacttgttcttttggcgcagcttgaggcgttgacccagcgcctgggtgaactgtctcagcaggtggcccagctgcgcgagcaaactgagtctgctgttgccacagcaaagtctaaataaagattaatcaataaataaaggagatacttgttgattttaaactgtaatgaatctttatttgatttttcgcgcacggtatgccctggaccaccggtctcgatcattgagaactcggtggatcttttccaggaccctgtagaggtgggattgaatgtttagatacattggcattaggccgtctcgagggtggagatagctccattgaagagcctcgtgttccggggtagtgttataaatcacccagtcataacaaggtcggagtgcatgatgttgcacaatatctttaaggagcaggctgattgcaactgggagccccttggtgtatgtgtttacaaatctgttgagctgagatggatgcattctgggtgaaattatatgcatttttgactggatcttgaggttggcaatgttgccgcccagatcccgtctcgggttcatgttatgcaggaccaccaagacggtgtatccggtgcacttaggaaatttatcatgcagcttagatggaaaagcatgaaaaaatttggagacgcctttgtgtccgcccaaattctccatgcactcatccataatgatagcaatggggccgtgggcggcggcacgggcaaacacgttccggggatctgacacatcatagttatgctcctgagacaggtcatcataagccattttaataaactttgggcgtagggtgccagattggggtataaatgttccctcgggccccggagcatagtttccctcacagatttgcatttcccaggctttcagttcagagggggggatcatgtccacctgcggggctataaaaaataccgtttctggggctggggtgattaactgtgatgatagcaaattccttagcagctgtgacttgccacacccagtggggccgtaaatgaccccgattacgggttgcagatggtagtttagggagcggcagctgccgtcctctcggagcaggggggccacttcgttcatcatttcccttacatggatattttcccgcaccaagtccgttaggaggcgctctccacctagggataaaagttcctggagggaggagaagtttttgagcggcttcagcccgtcagccatgggcattttggagagagtctgttgcaagagctcgagccgatcccaaagctcggttatgtgttctatggcatctcgatccagcaaacctcctcgtttcgcggattggggcggctcctggagtagggtatcagacgatgggcgtccagcgctgccagtgtccgatccttccatggtcgcagcgtccgagtcagggttgtttccgtcacggtgaatgggtgcgcgcctggttgtgcgcttgcgagggtgcgcctcaggctcatcctgctggtcgagaaccgctgccgatcggcgccctgcatgtcggccaggtagcagtttaccatgagttcgtagttgagcgcttcggccgcatggcctttggcgcggagcttacctttggaagttttgtgacaggagggacagtatagacacttaagggcatacagcttgggtgcgaggaagattgattcgggggagtatgcatctgcgccgcaggaggcgcagacagtttcgcattccacgagccatgtcagatctggttcatctgggtcaaaaacaagttttccgccatattttttgatgcgtttcttaccttttgtctccatgagttcgtgtcctcgctgggtgacaaagaggctgtctgtgtccccgtagaccgactttataggcctgtcctcgagcggagtgcctcggtcctcttcgtataggaatcccgaccactctgatacaaaggcgcgtgtccaggctagcacaaatgaggctacttgggaagggtagcggtcgttgtcaaccagggggtccaccttctctacagtatgtaaacacatgtccccctcctccacatccagaaatgtgattggcttgtaaaggtatgccacgtgaccgggagtcccagccgggggggtataaaagggggcgggtctctgttcgtcctcactgtcttccggatcgctgtccaggagcgccaactgttggggtaggtattccctctcgaaggcaggcataacctctgcactcaggttgtcagtttctaggaacgatgaggatttgatattgacagtgcctgctgagatgcctttcatgagactttcgtccatttggtcagaaaagacaatctttttgttgtccaacttggtagcaaaggatccatatagggcattggataggagcttggctatggagcgcatggtttgattcttttccttgtccgcgcgttccttggcggcgatgttcagctggacatattcgcgcgccaggcacttccattcagggaagatggttgtcagttcatccggcacaattctgacttgccagcccctattatgtagggttatcagatccacactggtggccacctctcctcgaagaggttcgttggtccagcagagccgacccccctttctcgaacagaaagggggtagagggtctagcatgagctcatcaggggggtctgcatccatggtgaagattcctggaagtaggtccttgtcaaaatagctgatgggggtgggatcatctaaagccatctgccattctcgagctgctagcgcgcgctcatatgggttcagtggtgtaccccagggcatgggatgggtgagcgcagaggcatacatgccacagatgtcatagacataaaggggctcttctagtatgccgatgtatgtgggataacatcgcccccctctgatgcttgctcgcacataattatagagctcatgagatggggcaaggagacccgggcccagattagtgcggttgggcttctctgccctgtagacaatttggcgaaagatggcatgggaattagaagagatagttggcctttggaatatgttaaagtgggcatggggtaaacctacagaatccctgatgaagtgggcatatgattcttgcaacttggccactagctctgcggtgaccaggacgtccatggcgcagtagtcgagggtctctttgatgatgtcataacctggttggttttttttttcccacagctcgcggttgaggaggtattcttcgcgatccttccagtactcttcgaggggaaacccgtctttgtctgcacggtaagagcccagcatgtagaattgattgactgccttgtaaggacagcaccccttctccacagggagagagtatgcttgagcggctttgcgcagtgaggtatgagtaagggcgaaggtgtccctgaccataactttgaggaactggtacttgaagtcgatgtcgtcacacgtcccctgttcccagagttggaagtccacccgcttcttgtaggcggggttgggcaaagcgaaagtaacatcgttgaagagaatcttgccggccctgggcaaaaaattgcgggtaatgcggaaaggctggggcacctctgctcgattattgatcacttgcgcagctaggacgatctcgtcaaagccgttaatgttgtgccccactatgtacatttctatgaatcgtggggagcctctgatgtgaggtagctttttgagctcttcgaaggtgaggtctgtagggtcagagagagcgtagtgttcgagggcccattcgtgcaggtgagggtttgcattcatgaaagatgaccaaagatccactgccagtgctgtttgtaactggtcccggtactggcgaaaatgctgaccgactgccatcttttctggggtgacacagtagaatgttttggggtcctgctgccaacgatcccacttgagtttcatggcgagatcgtaggcgatgttgacgagccgttcgtcccccgaaagtttcatgaccagcatgaaggggactagctgctttccaaaggaccccatccaggtgtaggtttccacatcgtaggtgaggaagagcctttctgtacgaggatgagagccaatcgggaagaactggatctcctgccaccagttggaggaatggctgttgatgtgatggaagtagaactcccttcggcgcgccgagcattcatgcttgtgcttgtacagacggccgcagtactcgcagcgctgcacgggatgcacctcatgaatgagttgtacctggtttcctttgacaagaaatttcagtgggaagttgaggcctggcgtctgtacctcgtgctctactatgttatttgcatcggcctggccatcttctgtctcgatggtggtcatgctgacgagaccccgcgggaggcaagtccagatctcggcgcgggaggggcggagctcgaggacgagagcgcgcaggccggagctgtccagggtcctgagtcgctgcggagtcaggttagtagggaggctctggagattgacttgcaagattttttcgagggcatgggggaggttaagatggtacttgatctctactggtccgttggtggagatgtcgatggcttgcagggttccatgtcccttgggcgccaccactgtgcccttgtttttcctttttggcgggagtggtggtggctctgttgcttcttgcatgttcagaatcggtggcgagggcgagcgccgggcggtaggggcggctcgggccccggtggcatggccggcagtggcacgtcggcgccgcgtgcgggtaggttctggtactgcgccctgagaagacttgcgtgcgcaacgacgcggcggttgacgtcttggatctgccgcctctgggtgaaagctaccggacccgtgagcttgaacctgaaagagagttcaacagaatcaatttcggtatcgttaacggcggcctgtctcaggatctcttgcacgtcgcctgagttgtcctggtaggcgatctcggccatgaattgctcgatttcttcctcctgaagatctccgcgacccgctctctcgacggtggccgcgaggtcgttggaaatgcgggccatgagttgagagaatgcattcatgcccgcctcgttccagacgcggctgtagaccacggccccttcgggatctcttgcgcgcatgaccacctgggcaaggttgagctccacgtggcgcgtgaagaccgcatagttgcagaggcgctggtataggtagttgagtgtggtggcgatatgctcggtgacgaagaagtacatgatccatcgtctcagcggcatttcgctgacatcgcccagggcttccaagcgctccatggcctcgtagaagtccacggcgaagttgaaaaactgagagtttcgcgcggacacggtcaactcctcctccagaagacggatgagttcggcgatggtggcgcgcacttcgcgctcgaaggcccccgggatttcttcctcctcttctaactcttcttccactaacatctcttcttcctcttcaggcgggggcggaggaggaggagggggtacgcggcgacgccggcggcgcacgggcaaacggtcgatgaatctttcaatgacctctccgcggcggcggcgcatggtctcggtgacggcacggccgttctccctgggtctcaaagtgaaaacgcctccgcgcatctccctgaagtggtgacttgggggctctccgttgggcagtgaaagggcgctgattatgcactttatcaattgtcctgtagggactccgcgcaaggacctgatcgtctcaagatccacgggatctgaaaatctttcaacgaaagcgtctaaccagtcgcaatcgcaaggtaggctgagcactgtttcttgctggcgggggtggctacacgctcggtcggggttctctctttcttctccttcctcctcttgggagggtgagacgatgctgctggtgatgaaattaaaataggcagttctgagacggcggatggtggcgaggagcaccaggtctttgggaccggcttgctggatgcgcaggcgattggccattccccaagcattatcctgacacctggccagatttttgtagtagtcttgcataagtcgctccacgggcacttcttcttcgcccgctctgccatgcatgcgcgtgagcccaaacccacgcatgggctggacaagtgccaggtctgctacgaccctttctgcgaggatggcttgctgcacctgagtgagggtggcttggaagtcgtcgaagtccacaaaacgatggtaggccccggtgttgatggtgtaagagcagttggccatgactgaccagttaactgtctggtgccccgggcgcacaagctcggtgtacttgaggcgcgagtaggcgcgggtgtcaaagatgtaatcgttacaggtgcgcaccaggtactggtagccgatgagaaagtgcggcggcggctggcggtataggggccatcgctctgtagccggggcgccaggggcgaggtcttccagcatgaggcggtgataaccgtagatgtacctggacatccaggtgataccggaggcggtggtggatgcccgcgggaactcgcgtacgcggttccagatgttgcgcagcggcatgaagtagttcatggtaggcacggtttggcccgtgaggcgcgcacagtcgttgatgctctagacatacgggcaaaaacgaaagcggtcagcggctcgtctccgtggcctggaggctaagcgaacgggttgggctgcgcgtgtaccccggttcgaatctcggatcaggctggagccgcagctaacgtggtactggcactcccgtctcgacccaggcctgcacaaaacctccaggatacggaggcgggtcgtttttttttttttttgctttttcctggattggagccagtgctgcgtcaagctttagaacgctcagttcgcggggttgggagtggctcgcgcccgtagtctggagaatcaatcgccagggttgcgttgcggtgtgccccggttcgagtcttagcgcgccggatcggccggtttccgcgacaagcgagggtttggcagccccgtcatttctaagaccccgccagccgacttctccagtttacgggagcgagccctctttttttttttgttgcccagatgcatcccgtgctgcgacagatgcgcccccagcaacagcccccttctcagcagcagctacagcaacagccacaaaaggctcttcctgctcctgtaactactgcggctgcagccgtcagcggcgcgggacagcccgcctatgatctggacttggaagagggcgagggactggcgcgcctgggtgcaccatcgcccgagcggcacccgcgggtgcaactgaaaaaggactctcgcgaggcgtacgtgccccagcagaacctgttcagggacaggagcggcgaggagcctgaggaaatgcgagcttcccgctttaacgcgggtcgcgaactgcgtcacggtctggaccgaagacgggtgctgcgtgatgatgattttgaagtcgatgaagtgacaggaataagtcctgctagggcacatgtggccgcggccaacctagtatcagcttacgagcagaccgtgaaggaggagcgcaactttcaaaaatctttcaacaaccatgtgcgcaccctgattgcccgcgaggaagtgacactgggtctgatgcacctgtgggacctgatggaagctattacccagaaccccaccagcaaacctctgaccgctcagctgtttctggtggtgcaacatagtagagacaatgaggcatttagggaggcgctgttgaacattactgagcccgaggggagatggttgtatgatcttatcaatattctgcaaagtataatagtgcaagaacgtagcctgggtctagctgagaaggtggctgctattaactactcggtcttgagcctgggcaagcactacgctcgcaagatctacaaaaccccatacgtacctatagacaaggaggtgaagatagatgggttttatatgcgcatgactctcaaggtgctgaccttgagtgacgatctgggagtgtaccgcaacgacaggatgcaccgcgcagtgagcgccagcagaaggcgtgagctgagcgacagagaacttatgcacagcttgcaaagagctctgacgggggctggaaccgagggggagaactactttgacatgggagcggacttgcagtggcagcccagtcgcagggccctggacgcagcagggtatgagcttccttacatagaagaggtggatgcaggccaggatgaggagggcgagtacctggaagactgatggcgcgaccatccatatttttgctagatggaacagcaggcaccggaccccgcaatacgggcggcgctacagagccagccgtccggcattaactcctcggacgattggagccaggccatgcaacgcatcatggcgctgacgacccgcaaccccgaagcctttagacagcaaccccaggccaaccgcctttctgccatcctggaggccgtagtgccctcccgctccaaccccacacacgagaaggtcctggccatcgtgaacgcgctggtggagaacaaagccatacgtcccgatgaggctgggctggtatacaatgccctattggagcgcgtagcccgttacaacagcagcaacgtgcagaccaacctggaccggatggtgaccgatgtgcgcgaggccgtgtcccagcgcgagcggttccagcgagacgccaatttagggtcgctggtggctttgaacgccttcctcagcactcagcctgccaacgtgcctcgcggtcagcaagactacacaaactttctaagtgcattaagactcatggtggccgaagtccctcaaagcgaagtgtaccagtccgggccagactactttttccagaccagcagacagggcttgcagacagtgaacctgagccaggcttttaagaacctgaatggtctgtggggagtgcgcgccccagtgggagatcgggcgaccgtgtctagcttgctgacccccaactcccgcctactacttctcttggtagccccattcactgacagcggtagcatcgaccgtaattcttacttgggctatctgttgaacctgtatcgcgaggccatagggcaaactcaggtagatgagcaaacctatcaagaaattacccaagtgagccgcgctctgggtcaggaggacactggcagcttggaagccaccttaaacttcttgctgaccaaccggtcgcagaagatccctcctcagtatgcgcttaccgcggaggaggaacggatcctgagatacgtgcagcagagcgtgggactgttcctaatgcaggagggggcgactcctactgctgcgctcgatatgacagcccgaaacatggagcccagcatgtatgccagtaaccggccttttatcaataaactgctagactacttacacagggcggctgctatgaactctgattatttcaccaatgctatcctgaacccccattggctgcccccacctgggttctatacgggcgagtatgacatgcccgaccccaatgacgggtttttatgggacgatgtggacagtagtgttttctccccgcctcctggttataacacttggaagaaggaaggtggcgatagaaggcactcttccgtgtcactgtccggggcaacgggtgctgccgcagcggttcccgaggctgcaagtcctttccctagtttgccattttcgctaaacagtgtacgcagcagtgagctgggaagaataacccgtcctcgcttgatcggcgaggaggagtatttgaacgactccctgttgagacccgagagggagaagaatttccccaacaacgggatagaaagcttggttgacaaaatgaaccgctggaagacgtacgcgcacgatcacagggacgatccccgggcgctgggggatagccggggcagcgctacccgtaaacgccagtggcacgacaggcagcggggcctggtgtgggccgatgaggattccgccgacgacagcagcgtgttggacttgggtgggagtggtggtaacccgttcgctcacctgcgcccccgcgtcgggcgcctgatgtaagaaaccgaaaataaatactcaccaaggccatggcgaccagcgtgcgttcgtttcttctctgttatatctagtatgatgaggcgaaccgtgctaggcggagcggtggtgtatccggagggtcctcctccttcgtacgagagcgtgatgcagcaggcggcggcggcggcgatgcagccaccactggaggctccctttgtaccccctcggtacctggcacctacggaggggagaaacagcattcgttactcggagctggcaccattgtatgataccacccggttgtatttggtggacaacaagtccgcggacatcgcctcactgaactatcagaacgaccacagcaacttcctcaccacggtggtgcaaaacaatgactttacccccacggaggccagcacccagaccatcaactttgacgagcggtcgcgatggggcggtcagctgaagactatcatgcacaccaacatgcccaacgtgaacgagtacatgtttagcaacaagttcaaagctcgggtgatggtgtctagaaaggctcctgaaggtgtcacagtagatgacaattatgatcacaagcaggatattttggaatatgagtggtttgagtttactctaccggaagggaacttctcagccacaatgaccattgacctaatgaacaatgccatcattgataattaccttgaagtgggcagacagaatggagtgttggagagtgacattggtgttaaatttgacaccaggaactttagactgggttgggatccggaaactaagttgattatgcctggggtttacacctatgaggcattccatcctgacattgtattgttgcctggttgcggagttgactttactgaaagtcgccttagtaacttgcttggtatcaggaaaagacacccattccaggagggttttaagatcttgtatgaggatcttgaagggggtaatatcccggccctgttggatgtagaagcctatgagaacagtaagaaagaacaagaagccaaaacagaagccgctaaagctgctgctattgctaaagccaacatagttgtcagcgaccctgtaagggtggctaatgccgaagaagtcagaggagacaactatacagcttcatctgttgcaactgaagaatcgctattggctgctgtggccgaaaccgaaactacagagacaaaactcactattaaacctgtagaaaaagacagcaagagtagaagttacaatgtcttggaagataaagtcaatacagcctaccgcagctggtacctgtcctacaactatggtgaccctgaaaaaggagtccgttcctggacactgctcaccacctcggatgtcacctgtggagcagagcaggtgtactggtcgctcccagacatgatgcaggaccctgtcacattccgttccacgagacaagtcagcaactatccagtggtaggtgcagagctcatgccggtcttctcaaagagtttctacaacgagcaagccgtgtactcccagcagcttcgccagtccacctcgctcacgcacgtcttcaaccgcttccctgagaaccagatcctcatccgcccgccagcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaaaaaaaaaaaaaatgtccattcttatctcacctagtaataacaccggttggggcctgcgcgcgccaagcaagatgtacggaggtgctcgcaaacgctctacacagcaccctgtgcgcgtgcgcgggcacttccgcgctccatggggcgccctcaagggtcgtacccgcactagaaccaccgtcgatgatgtgatcgaccaggtggtggccgatgctcgtaattatactcctactgcacctacatctactgtggatgcagttattgacagcgtagtggctgacgcccgcgcctatgctcgccggaagagcaggcggagacgcatcgccaggcgccaccgggctactcccgctatgcgagcggcaagagctctgctacggagggccaaacgcgtggggcgaagagctatgcttagagcggccagacgcgcggcttcaggtgccagtgccggcaggtcccgcaggcgcgcagccacggcggcagcagcggccattgccaacatggcccaaccgcgaagaggcaatgtgtactgggtgcgcgacgccaccaccggccagcgcgtgcccgtgcgcacccgcccccctcgctcttagaagatactgagcagtctccgatgttgtgtcccagcgaggatgtccaagcgcaaatacaaggaagagatgctccaggtcatcgcgcctgaaatctacggtccgccggtgaaggatgaaaaaaagccccgcaaaatcaagcgggtcaaaaaggacaaaaaggaagaagatggcaatgatggtctggtggagtttgtacgcgagttcgccccaaggcggcgtgtgcagtggcgtggacgcaaagtgcggcctgtgctgagacctggaaccacggtggtctttacgcccggcgagcgcaccagcactgcttttaagcgatcctatgatgaggtgtatggggatgatgatattctggagcaggcggccgaccgcctgggcgagtttgcttatggcaagcgctcccgctccagccccaaggaggaggcggtgtccattcccttggacaatgggaatcccacccctagcctcaagccagtcaccctgcagcaagtgctgcccgtgcctccacgcagaggcaacaagcgagagggtgaggatctgtatcccacgatgcaattgatggtgcccaagcgccagcggctggaggacgtgctggagaaaatgaaagtggatcccgatatacaacctgaggtcaaagtgagacccatcaagcaggtggcgccaggtttgggagtacaaaccgtagacatcaagattcccaccgagtccatggaagtccaaaccgaacctgcaaagcccacaaccacctccattgaggtgcaaacggatccctggatgtccgcacccgttacagctcaagctgctgtcaacaccactcgaagatcccggcgaaagtacggtccagcaagtttgctaatgccaaattatgctctgcacccatctattattccaactccgggttaccgaggcactcgctactaccgcagccggagcagcacttcccgccgtcgccgcaaaacacctgcaagtcgtagtcaccgtcgtcgtcgccgccccgccagcaatctgacccccgctgctctggtgcggagagtgtatcgcgatggccgcgcagatcccctgacgttgccacgcgtacgctaccatccaagcatcacaacttaacgactgttgccgctgcctccttgcagatatggccctcacttgccgccttcgtgtccccattactggctaccgaggaagaaactcgcgccgtagaagagggatgttggggcgcgggatgcgacgccacaggcggcggcgcgctatcagcaaaaggctggggggtggctttctgcctgctctgatccccatcatagccgcggcgatcggggcgataccaggcatagcttccgtggcggttcaggcctcgcagcgccactgacattggaaaaacttataaataaaatagaatggactctgatgctcctggtcctgtgactatgtttttgtagagatggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcactgagaaataagcttaaagagcaaaacttccaacagaaggtggttgatgggatcgcctctggtatcaatggggtggtggatctggccaaccaggccgtgcagaaacagataaacagccgactggacccgccgccgtcagccacgggtgaaatggaagtggaggaagatctccctccccttgaaaagcggggcgacaagcgtccgcgccccgatctggaggagacactagtcacacgctcagacgacccgccctcctacgaggaggcagtgaagcttggaatgcccaccaccagacctgtagcccccatggctaccggggtaatgaaaccttctcagtcacaccgacccgctaccttggacttgcctcctccccctactgctgcagcgcctgctcgcaagcctgtcgctaccccgaagcccaccaccgtacagcccgtcgccgtagccaggccgcgtcctgggggcactccacgtccaaatgcaaactggcagagtactctgaacagcatcgtgggtctgggcgtgcaaagtgtaaagcgccgtcgctgcttttaaattaaatatggagtagcgcttaacttgcctgtctgtgtatgtgtcatcatcacgccgccgccgcagcaacagcagaggagaaaaggaagaggtcgcgcgccgaggctgagttgctttcaagatggccaccccatcgatgctgccccagtgggcatacatgcacatcgccggacaggatgcttcggagtacctgagtccgggtctggtgcagttcgcccgcgccacagacacctacttcaatctggggaacaagtttaggaaccctaccgtggcgcccacccatgatgtgaccaccgaccgcagtcaacggctgatgctccgctttgtgcccgttgaccgggaggacaatacctactcatacaaagttcgatacaccttggctgtgggcgacaacagagtgctggatatggccagtactttctttgacattcggggtgtgttggatagaggccctagcttcaagccatattctggcactgcttacaactcattggcccctaagggcgctcccaatacatctcagtggcttgataagggagtcactaccactgataatactgaaaacggagatgaagaagatgaagttgccgaggaaggggaagaagacaaacaagctacgtacacttttggcaatgcgccagtaaaagccgaagctgaaattacaaaagaaggactgccaataggtttggaagttccatctgaaggtgaccctaaacccatttatgctgataaactgtatcagccagaacctcaggtgggagaggaatcttggactgatacggatggtacagatgaaaaatatggaggcagagcacttaaacctgaaactaaaatgaaaccctgctacgggtctttcgctaaacctactaatgtcaaaggcggccaggcaaaagtgaagaaagtagaagagggcaaggttgaatatgacattgacatgaactttttcgacctaagatcacaaaagactggtctcaagcctaaaattgtcatgtatgcagaaaatgtggatctagaaactccagacactcatgtggtgtacaaacctggagcttcagatgctagttctcatgcaaaccttggtcaacagtccatgcccaatagacctaactatattggcttcagggacaacttcatcggactcatgtactataacagtactggcaatatgggagtgctggctggacaagcgtcccaattgaatgcggtggttgacttgcaggacagaaacacagaattgtcgtatcagctcttgcttgattctctgggggacagaaccagatatttcagcatgtggaatcaagcagtggatagctatgacccagatgtgcgtgtcattgaaaaccatggtgtggaagatgaactccccaactattgttttccattggatggtgtaggtccgcgaacagacagttacaagggaattgagacaaatggtgatgaaaacactacttggaaagatttagatccaaatggcataagtgaaattgctaagggaaatccatttgccatggaaattaacctccaagctaatctatggagaagttttctttattccaatgtggctctgtatctcccagactcctacaaatacacgccaactaatgttactctcccagaaaacaaaaacacctatgactacatgaatggacgggtggttcccccatccctagtggatacctacgtaaacattggcgccagatggtctttggatgccatggataatgtcaaccccttcaaccatcaccgcaacgctggcctgcgataccgatccatgcttctgggcaacggtcgctacgtgcctttccacattcaagtgcctcagaaattctttgctgtgaagaacctgctgcttctacccggttcttacacctacgagtggaacttcagaaaggacgtgaacatggtcctgcagagttcccttggcaatgatctccgggttgatggcgccagcatcagttttaccagcatcaatctctatgccaccttcttccccatggcccacaacactgcctccacccttgaagccatgctgcgcaatgacaccaatgatcaatcattcaatgactacctttctgcagccaacatgctctaccccatcccggccaacgctaccaacgttcccatctccattccctctcgcaactgggccgccttcagaggctggtccttcaccagactcaaaaccaaagagactccctctttgggatcagggttcgatccctactttgtttactctggttctataccttacctggatggtactttctaccttaaccacacttttaagaaagtctctatcatgtttgactcttcagtcagctggcctggtaatgacagattgctaactccaaatgagttcgaaatcaagcgcacagttgatggggaaggctacaatgtggcccaatgtaacatgaccaaagactggttcctggtccagatgcttgccaactacaacattggataccagggcttctacgttcctgagggttacaaggatcgcatgtactccttcttcagaaacttccagcccatgagtagacaggtggttgatgagattaactacaaagactataaagctgtcgccgtaccctaccagcataataactctggctttgtgggttacatggctcctaccatgcgtcagggtcaagcgtaccctgctaactacccataccccctaattggaaccactgcagtaaccagtgtcacccagaaaaaattcctgtgcgacaggaccatgtggcgcatcccattctctagcaacttcatgtccatgggtgcccttacagacctgggacagaacttgctgtatgccaactcagcccatgcgctggacatgacttttgaggtggatcccatggatgagcccaccctgctttatcttctttttgaagtattcgacgtggtcagagtgcaccaaccacaccgcggcgtcatcgaggccgtctacctgcgcacaccgttctcggctggtaacgccaccacataagaaacctgcttcttgcaaggtgcagccatggcctgcgggtccggaaacggctccagcgagcaagagctcaaagccatcgtccgagaccttggctgtggaccctacttcctgggaacctttgacaaacgcttcccggggtttatggctccaaacaagctggcctgcgccattgtcaacacagccggtcgcgagacggggggagagcactggttggcttttggttggaacccgcgctccaacacatgctacctttttgatccgtttggattttcggatgaccgtctcaagcagatctaccagtttgaatacgaggggttactgcgccgcagcgcccttgctactaaggatcgctgcattaccttggaaaagtccacccaaaccgtgcagggtccgcgctccgccgcttgtggacttttttgctgcatgtttctccatgcctttgtacactggccagaccgccccatggacggtaaccccaccatgaagttgcttacgggagtgcccaacagcatgctccagtcaccccaagtccagcccaccctgcgcaggaaccaggaggcgctctaccatttcctcaacacacattcatcttactttcgttctcaccgcgcacgtatcgaaagggctactgcgttcgatcgtatgggatattaataagtcatgtaaaaccgtgttcaataaacagaactttattttttacatgcactggtggtttctcattcatttattcactcagaagtcgaaggggttttggcgggaatcagagtgacccgcgggcagggatacgttgcggaactggaactgagcctgccacttgaattcggggatcaccagcttgggaactggcaggtcaggcaggatgtcgctccacagcttcctggtcagttgcagggctcccaacaggtcaggagctgaaatcttgaaatcgcaattgggacccgtgctctgagcgcgggagttgcgatacacagggttgcaacactggaacaccatcagcgacgggtatttcacactcgccagcacagtgggatcggtgataattcccacatccaggtcttcggcattggccatgctaaagggggtcatcttgcatgtctgtctgcccatagccggtacccagcctggcttgtggttgcaatcgcagcgcagagggatcagcatcatcttggcctggtcggatctcataccgggatacacagctttcatgaaagcttcatattgcttgaaagcctgttgggccttgctaccctcagtgtagaacatcccacaagacttgctagagaactggttagcagcacatccggcatcattcacacaacagcgagcgtcgttgttggctatttgcaccacactcctgccccagcggttctgggtgatcttggttcgctcagggttctccttcagcgcccgttgaccgttttcgcttgccacatccatttctatgatatgttccttctgaatcatgatgttgccatgcaaacacttcagcttgccttcataatcattacatccatgtgaccacagcgcgcatcccgtacactcccagttattgtgagcgatctcagaataggaatgcaccaacccctgcaggaatcttcccatcatggttgagagggtcttgttactggtgaaagtcagcgggacgcctcgatgctcctcgttcacatactggtggcaaattcgcttgtactgttcatgctgctctggcataagcttgaaagaggttcttaggtcattctccagcctgtacttctccatcagcacagccattacttccatgcccttttcccaggcagaaaccaggggtaggctcatggaatttctaacagaaatagcagctactttagccagagggtcatccttgtcaatcttctcaacacttcttttgccatccttctcagtgatgcgcacgggtgggtagctgaagcccacggccaccagctccgcctcttctctttcttcttcgctgtcctgactgatgtcttgtaaagggacatgcttggtcttcctgggcttctttttggggggtattggcggagggctgctgctccgctccggagacatggaggaccgcgaagtttcgctcaccagtaccacctggctctcggtagaagaaccggaccccacacggcggtaggtgttcctcttcgggggcagaggtggaggtgactgcgatgggctgcggtccggcctgggaggcggatgactggcagagccccttccgcgttcgggggtgtgctcccggtggcggtcgcttgactgatttcctccgcggctggccattgtgttctcctaggcagagaaacaacagacatggagactcagccatcgctgccaacaccgctgcaagcaccatcacacctcgcctccagcgatgaggaggaggaacaaagcttaaccgccccaccacccagtcccgccaccaccacctctaccctcgaggatgaggaggtcgacgcaccccaggagatacggacgcaggatatggaggatgagaaagcggaagagattgaggcagatatcgagcaggacccaggctatgtgacaccggccgagcacgaggaagagctgagacgctttctagagaaagatgatgacaaccgtccagaacagcaagcagatggcgatcagcagaatgttgggctcggggatcatgttgtcgactacctcaccggccttggtggggaggacgtgctcctcaaacacctagcaaggcagtcgatcataatcaaagatgcactgcttgatcgcagcgaagtgcccatcagtgtggaagagctcagccgcgcctacgagctcaacctgttctcgcctcgggtaccccccaagcgtcagccaaacggcacctgtgagcccaaccctcgcctcaacttctatccggcctttgctgtcccagaagtgcttgctacctaccacatctttttcaagaaccaaaagattccagtttcctgccgtgccaaccgcacccgcgccgatgccctgctcaacttgggtccgggagctcgcttacctgatatagcttccttggaagaggttccaaagatcttcgagggtctgggcagtgatgagactcgggccgcaaatgctctgcaacagggagagaatggcatggatgaacatcacagcgctctggtggagttggagggagacaatgcccggcttgcagtgctcaagcgcagtatcgaggtcacccattttgcataccccgctgtcaacctgccccccaaagtcatgagcgctgtcatggatcagctgctcatcaagcgcgcaagccccctttccgaagaccagaacatgcaggatccagacgcctcggacgagggcaagccggtggtcagtgacgagcagctgtctcgctggctggccaccaactccccgcgagacttggaagagaggcgcaagcttatgatggctgtagtgctagtcactgtggagctggagtgtctccgccgctttttcaccgaccctgagaccctgcgcaagctcgaggagaacctgcactatactttcagacatggtttcgtgcgccaggcatgcaagatctccaacgtggagctcaccaacctggtctcctacatgggcattttgcatgagaaccgcctggggcagagcgtgttgcataccaccctgaaaggggaggcccgccgcgactacatccgcgactgtgtctacctctacctctgccatacctggcagactggcatgggtgtatggcagcagtgtttggaagagcagaacctgaaagagctggacaagctcttgcagagatccctcaaagccctgtggacaggttttgacgagcgcaccgtcgcctcagacctggcagacatcatcttccccgagcgtctcagggttactctgcgcaacggcctgcctgacttcatgagccagagcatgcttaacaactttcgctctttcatcctggaacgctccggtatcctgcccgccacctgctgcgcgctgccctccgactttgtgcctctcacctaccgcgagtgccccccgccgctatggagccactgctacctgttccgcctggccaactacctctcctaccactcggatgtgatcgaggatgtgagcggagacggcctgctggagtgccactgccgctgcaatctttgcacaccccaccgttccctcgcctgcaacccccagttgctgagcgagactcagatcatcggcaccttcgagttgcagggtcccagcagtgaaggcgaggggtcttctccggggcagagtctgaaactgaccccggggctatggacctccgcctacctgcgcaagttcgcccccgaagactaccacccctatgagatcaggttctatgaggaccaatcacagccgcccaaaaccgagctctcagcctgcgtcatcactcagggggcaattctcgcccaattgcaagccatccaaaaatcccgccaagaatttctgctgaaaaaggggaacggggtctacctcgacccccagaccggtgaggagctcaacacaaggttccctcaggatgtcccagcgccgaggaagcaagaagttgaaggtgcagctgccgcccccagaggatatggaggaagactgggacagtcaggcagaggaggaggagatggaagattgggacagccaggcagaggaggtggacagcctggaggaagacagtttggaggaggaagacgaggaggcagaggaggtggaagaaacaaccgccgccaaacagttgtcctcggcagcggagacaagcaaggccccagacagcagcagcacggctacaatctccgctccgggtcggggggcccagcagcgtcccaacagtagatgggacgagaccgggcgattcccgaacccgaccaccgcttccaagaccggtaagaaggagcggcagggatacaagtcctggcgggggcataagaatgccatcatctcctgcttgcatgaatgcgggggcaacatatccttcaccaggcgctacctgctcttccaccacggggtgaacttcccccgcaatgtcttgcattactaccgtcacctccacagcccctactacagccagcaagtcccggcagcctcggcagagaaagacagcagcagcagcggggacctccagcagaaaaccagcagcagcagttagaaaatccagtgcagcaggaggactgaggatcacagcgaacgagccagcgcagacccgagagctaagaaacaggatctttccaaccctctatgccatcttccagcagagtcgggggcaagagcaggaactgaaagtaaaaaaccgatctctgcgctcgctcacccgaagttgtttgtatcacaagagcgaagaccaacttcagcgcactctcgaggacgccgaggctctcttcaacaagtactgcgcgctgactcttaaagagtagcccgcgcccgcgctcgctcgaaaaaggcgggaattacgtcacccttggcacctgtcctttgccctcgtcatgagtaaagaaattcccacgccttacatgtggagctatcagccccaaatgggactggcagcaggcgcctcccaggactactccacccgcatgaattggctcagcgccggcccctcgatgatctcacgggttaatgatatacgagcttaccgaaaccagttactcctagaacagtcagctctcaccaccacaccccgccaacaccttaatccccggaattggcccgcctccctggtgtaccaggaaactcccgctcccaccaccgtactacttcctcgagacgcccaggccgaagttcagatgactaacgcaggtgtacagctggcgggcggttccgccctgtgtcgtcaccggcctcagcagagtataaaacgcctggtgatcagaggccgaggtatccagctcaacgacgagtcggtgagctcttcgcttggtctgcgaccagacggagtcttccaaatcgccggctgtgggagatcttccttcactcctcgtcaggctgttctgactttggagagttcgtcctcgcagccccgctcgggcggcatcgggactctccagtttgtggaggagtttactccctctgtctacttcaaccccttctccggctctcctggccagtacccggacgagttcataccgaacttcgacgcaatcagcgagtcagtggatggctatgattgatgtctggtggcgcggctgagttagctcgactgcgacatctagaccactgccgccgctttcgctgtttcgcccgggaactcaccgagttcatctacttcgaactccccgaggagcaccctcagggaccggcccacggagtgcggattaccatcgaagggggaatagactctcgcctgcatcggatcttctgccagcgacccgtgctgatcgagcgcgaccagggaactacaacagtctccatctactgcatctgtaaccaccccggattgcatgaaagcctttgctgtcttatttgtgctgagtttaataaaaactgagttaagactcgccttcggactaccgcttcttcaacccggactttacaacaccagccagaccctccgttccagccagaagacccagacccttcctctcatccaggactttaattctacctccccagcaccatcccctactaaccttcccgatactaacaacctcggagctcagctgcaacaccgcttctccagaagcctcctttctgccaatactactactcccagaaccggaggtgagctccgtggtctccctactgacaacccctgggtggtagcgggttttgtagcgctaggagtagttgcgggtgggctggtgcttatactctgctacctatacacaccttgctgtgcttatttagtagtgttgtgttgctggtttaagaaatgggggtcgtactagtatcgcttgctttactttcgcttttgggtctgggctctgctaatcttcccgatcacgatccatgtctggactttgatccagagaactgcacactcacttttgcacctgaaacaagtcgcttctgtggagttcttattaggtgcggacgggaatgcagacccattgagattacacacaataacaaaacttggaacaataccttattcacaatatggcaaccaggagatcctcagtggtatactgtctctgtccggggtcctgacggttccgtccgcatggctaataacactttcatttttgctgaaatgtgcgatatggccatgttcatgagcagacagtatgacctatggcctcccagcaaggagaacattgtcgcattctccattgcttattgtttgggtacatgcatcatcactgctatcatgtgtgtatgcatacacgtgcttatagccattcgccccagaaacagcaatgaggaaaaagaaaaaatgccataacttttacaacttttttttcagacatggcttcagctctttttattcttgctatcattactgttatttccgcacagacaatagtagatatacccattggttctaactacaccctaataggacctacaacatatacagaagttatctggtgtaggcttagtactgaagattattataatgtattttgtgatggagatgatgacattcaagtaacctgtgacaaacaaaatcttacactcattaatgttacccagagttacagcggttacttttatggatatgatagatatagcagtgaatttaaaaattacatggtacgaataatccagcccataaatgcaaacactaaaatggaaaaactccacatgaataacaccttaaatcttacaatctccccaactacaccatctgaacaaaatattccaaattcaatgattgcaataattgtggcggtggcggtgggaatggcaatcataatagcatgtatgcttatttatgcttgctgctacaaaaaatttagacgtgaaaaacaagatccactacttaattatgatttttaattttttattttttatacagacatgatttacacagttcttaccatctttagcttaatttctgcctcttatggtcgcacacatgttactttaactgctggatccaaatacacactaaaaggaccagatggtcacaatggtgttatttggtggaggatatttgacgatggagggtttgttaacccctgtagcacatctaacagatattcctgtaatggtaaagacctaactattattaatgccacaaaaagtgataatggctattactatggaactaactatattactagcttagactacaccattactgtcatatctcccaccacaccatcgccgcacaaaacaacaactttctctagcagcagtactataaccacaaccaaaattaaaacaacttctaatattgaacacgtgcaaaaaatggcttctaattctaccttacccgctaccaatgaaatccctaaatcaattattggaataattgtagcagcaatagtgggtttgtcaatcattatttcttgcataatttactatgcctgctgctatagaaaaatagaaaaaggagaccccctactaagctttgatatttaatctttttatagcactatgaaacacctatgtattttagctatttcaatttttagtttttgctcatctacccccatcgccactgccaatgtgcagactactttaaatcatgttaacactacaaattacacatctacctcatatgtaactatctcttctacccagcctattgctttctccacaattaaatccaaccatcagtctaaatttgcactacaactagaaatcactatcctaattgtaattggaataactattctagctgttcttctttattttatcttctgccgccaaatacccaatgttcatagaaaaccaaaaaaaagacccatttattgtcctatgattagtaaacctcacttggccttaaatgaaatctaaggtctattctttttctttttacagtatggtgatcaccaatcatgatccctagaaatttcttcttcaccatactcatctgtgctttcaatgtctgtgctaccttcacagcagtagccactgcaaccccagactgtataggagcatttgcctcctatgcactttttgcctttgttacttgcatctgcgtgtgtagcatagtctgcctggttattaattttttccaacttgtagactggatatttgtgcgcattgcctacctgcgtcaccaccccgaataccgcaatcaaaatgttgcggcacttctcaggcttatctaaaaccatgcaggctatactaccagtcattctgattctgctgctcccctgtgttgccttagctccagtcactactcgcaccccacctgaacaacttagaaaatgcaaatttcaacagccatggtcattccttgattgctaccaagaaaaatctgattttcccacatactggatagtgattgttggaataattaacatactctcatgcactttattctccttcctaatataccccatatttaattttgggtggaatgttcccaatgcacttgctcacccacaaaatccagaggaacacattccactacagaacatgcaacagccactagacttaatagattatgaaaatgagccacagcctccactactccctgccattagctacttcaacctaaccggtggagatgactgacccactcgccgcctccgctgctgacaaggaactacttgatattgacggccgtgcctccgaacagcgactcgcccaactacgcattcgccagcagcaggaacgtgccgccaaggagctcagggatgctattgagattcaccagtgcaaaaaaggcatattttgcttggtaaaacaagccaagatctcctacgagatcaccgctaacgaccaccgcctctcatatgagcttggcccgcagcgtcagaaatttacttgcatggtgggaatcaaccccatagtcatcacccagcaagccggagataccaagggttgcatccattgttcctgtgaatccaccgagtgcatctacaccctactgaagaccctctgcggccttcgagacctcctacccatgaactaatcacccccgcccctaccaattacaaaaagccaattaataaaaatcacttacttaaaatcagaaataaggtttttgtctgcgttgttttcaagcagcacctcacttccctcttcccaactctggtactccaagcctcggcgggtggcatacttcctccacactttgaaagggatgtcaaattttagttcctcttctttgcccacaatcttcatttctttatccccagatggccaaacgagctcggctaagcagctccttcaatccggtctacccctatgaagatgaaagcagctcacaacacccctttataaaccctggtttcatttcccccgatgggtttacacaaaattcagatggagttctaactcttaaatgtacagctccacttaccaccacaggtggttctcttcagcttaaagtgggtagggggcttacagttgacactactgacgggacattagaagaggacatacacatcttagcaccacttacaaaaactgcccactccataggtttatcattgggaaatgggttagaattaaaagacagcaaactatatgttaaactaggagatggtctaaaatttaactcaaacagcatatgtttagaccatgacattaacactttatggaccggaatgaatccgtccattaactgtaacattatgcaacaagatgacaatgacagcaaactaactctagttttaactaaaaatggaggaatggtaaatgcatatgtatcattagtaggggcatctgatattgtaaactcactatttacacgggccactgcaaatatcacaataaggctaagctttgatgcctctggcaatttactaacaagcctatcagacctaaaaaccccactgaatcacagatatggcaatgacatggacactgtcacattaactaatggcaagagttttatgcccagcactacagcctatccctttaatgacactacaagggataaagaaaactacatatatggtacctgttattataaatcaactgaagacgcattgtacccgctagaagttgccgtcacacttaacagacggatgagcagtgctgccgtttcttatgctatgactattgcttggactttaagtgcaaacacaccccctgaaactaccatagcaacccttgttacctcccccttcactttttcctatattagagaaaatgactgacaacaaaaataaattttaacttttttattgaaaatcagtttacaggatacgagtagttattttgcctcccccttcccatttcatagaatacaccaatctctccccacgcacagctttaaacatttggattccatttgaaatagtcatggatttggattccacattccacacagtttcagagctagataatcttggatcagtgatagagataaatccatcggggcagtccttcaaggtgatttcacagtccagttgctgaggatgcggctccggagtctggatcagagtcatctggaagaagaacgatgggagtcataatccgagaacgggatcgggcggttgtgtctcatcaaaccccgaagcagtcgctgtctgcgccgctccgtgcgactgctgctgatgggatcggggtccacagtctctcgaagcatgattctaatagccctcaacattaacatcctggtacgatgtgcacagcaacgcatcctgatctcacttaggtcacagcagtaagtacaacacatcaccacaatgttgtttaacaggccataattaaaggcgctccagccaaaactcatttcaggaataatttgccccgcgtggccatcgtaccaaatcctgatgaaaatcaaatggcgccccctccagaatacactgcccacatacatgatctctttaggcatatgcatattcacaatctctcggtaccatggacagcgctgattaatcatgcagccccgaataaccttccggaaccaaatggccagcactgcgcccccagcaatacattgaagagaaccctgtcgattacagtgacaatggagaacccacttctctcgcccatggatcacttgggaataaaatatatctattgtggcacaacacagacataaatgcatacaccttctcatcacccttaactcttcaggggttaaaaacatatcccagggaataggaagctcttgcaaaacagtaaaggtggcagaacaaggcagacctcgaacataacttacactgtgcatggtcaaggtattgcaatctggtaacagcggatgctcttcagtcatagaagctctggtttcactttcctcacagcgtggtaaaggggccctcagttgaggttccctggtgtaaggatggtgtctggcgcacaatgtcgagcgtgcccgcgacctcgttgtaatggagctgcttcctgacattctcgtattttgcatagcagaacctagtcttggcacagcacacgtcccgtcgcctcctgtcccgccgcctagcacgttcagtgtggtaattatagtacaaccattcccgcagattggtcaaaagatcttcagcctcagttgtcataaaaactccatcatatcttactgctctgataaaatcattcacggtagaaagtgcaatgcccagccaggcaatgcaattagcttgtgtttcaaccaaaggagggggaggaagacatggaagaaccataattaatttttatgccagacgatcccgcagtatttctatatggagatcacgaagatggcacctctcgcccccactgtgttgatgaaaaatgacagctaggtcaaacataatgcgattttccaggtgctcaacggtggcttcaagcaaagcctccaaacgcacatccaaaaacaaaagaacagcaaaagcaggagcattttctaattcctcaatcatcatattacattcctgtaccattcccaaataattttcatctttccatccttgaattattcgtgttatttcatctggtaaatccaatccacacatgagaaatagctcccggagggcgccctccaccggcaatcttaagcacaccctcatagtgacaaaatatcgtgctcctctgtcacctgcagcaaattgagaatggcaatatcaaacggaatgccactggctctaagttcttctctaagttccagttgtaaatattcttgcatatcatcgccaaactgcttagccataggtcctccaggaataagagcgggggacgctacagtgcagaacaagcgcatgcctccccaattgcctccagcaaaagtgaggttgcaatatgcatactgagaacctccagtgatatcatccagtgtactggaaagataatcaggcagagcttctcgtatgcaattaataatagaaaagtctgccagatgcacatttaaagcctgtgggatgcagatgcaataagttatcgcgctgcgttccaacattgttagtatggttagtctgtaaaaaacaaaaacgaaaaaaattacatcacgctatactggcgaacgggtggataaatcactctctccaacaccaggcaggctacagggtctccagcgcgaccctcgtaaaacctgtcagtatgattaaaaagcatcaccgaaagaggttgttgatggccagcatatattatttgcgatgaagcatacaaaccagaagtgttagtatcagttaaagaaaaaaatcggccaagatagcatctcggaacgattatgctcaatctcaaatgcagcaaagcgacacctcgcggatgcaaagtaaaatccacaggagcataaaaaatgtaattattcccctcttgcacaggcagcctagctcccggcccctccaaaatcacatacaaagcttcagcagccatagcttaccgcgcaaatcaggcacagcagtcagatagagaaaaagctgtgaactgactgcccagcctgtgcgcaatatatagagaacccatacactgacgtaattgggcaaagtctaaaaaatcccgccaaaaaaccagcacacgcccaaaagtgtgtcacccgctaaaaaaataattttcacttcctcgttccgtatgtgacgtcaattccgatttcccacgaatcgtcacttccggccatcttgcaacgtcacctccccgcgccggcccgccccttttgaccgttaaaccccgtagccaatccccttccgctctccattttcaaaccacctcatttacatattggcaccgttccatctataaggtatattattgatgatg

SEQ ID NO: 37 - protein, 832 aa, Ape adenovirus BZ34
METQPSLPTPLQAPSHLASSDEEEEQSLTAPPPSPATTTSTLEDEEVDAPQEIRTQDMEDEKAEEIEADIEQDPGYVTPAEHEEELRRFLEKDDDNRPEQQADGDQQNVGLGDHVVDYLTGLGGEDVLLKHLARQSIIIKDALLDRSEVPISVEELSRAYELNLFSPRVPPKRQPNGTCEPNPRLNFYPAFAVPEVLATYHIFFKNQKIPVSCRANRTRADALLNLGPGARLPDIASLEEVPKIFEGLGSDETRAANALQQGENGMDEHHSALVELEGDNARLAVLKRSIEVTHFAYPAVNLPPKVMSAVMDQLLIKRASPLSEDQNMQDPDASDEGKPVVSDEQLSRWLATNSPRDLEERRKLMMAVVLVTVELECLRRFFTDPETLRKLEENLHYTFRHGFVRQACKISNVELTNLVSYMGILHENRLGQSVLHTTLKGEARRDYIRDCVYLYLCHTWQTGMGVWQQCLEEQNLKELDKLLQRSLKALWTGFDERTVASDLADIIFPERLRVTLRNGLPDFMSQSMLNNFRSFILERSGILPATCCALPSDFVPLTYRECPPPLWSHCYLFRLANYLSYHSDVIEDVSGDGLLECHCRCNLCTPHRSLACNPQLLSETQIIGTFELQGPSSEGEGSSPGQSLKLTPGLWTSAYLRKFAPEDYHPYEIRFYEDQSQPPKTELSACVITQGAILAQLQAIQKSRQEFLLKKGNGVYLDPQTGEELNTRFPQDVPAPRKQEVEGAAAAPRGYGGRLGQSGRGGGDGRLGQPGRGGGQPGGRQFGGGRRGGRGGGRNNRRQTVVLGSGDKQGPRQQQHGYNLRSGSGGPAASQQ

SEQ ID NO: 38 - protein, 205 aa, Ape adenovirus BZ34
MSQRRGSKKLKVQLPPPEDMEEDWDSQAEEEEMEDWDSQAEEVDSLEEDSLEEEDEEAEEVEETTAAKQLSSAAETSKAPDSSSTATISAPGRGAQQRPNSRWDETGRFPNPTTASKTGKKERQGYKSWRGHKNAIISCLHECGGNISFTRRYLLFHHGVNFPRNVLHYYRHLHSPYYSQQVPAASAEKDSSSSGDLQQKTSSSS

SEQ ID NO: 39 - protein, 224 aa, Ape adenovirus BZ34
MSQRRGSKKLKVQLPPPEDMEEDWDSQAEEEEMEDWDSQAEEVDSLEEDSLEEEDEEAEEVEETTAAKQLSSAAETSKAPDSSSTATISAPGRGAQQRPNSRWDETGRFPNPTTASKTGKKERQGYKSWRGHKNAIISCSAAGGLRITANEPAQTRELRNRIFPTLYAIFQQSRGQEQELKVKNRSLRSLTRSCLYHKSEDQLQRTLEDAEALFNKYCALTLKE

SEQ ID NO: 40 - protein, 389 aa, Ape adenovirus BZ34
MHPVLRQMRPQQQPPSQQQLQQQPQKALPAPVTTAAAAVSGAGQPAYDLDLEEGEGLARLGAPSPERHPRVQLKKDSREAYVPQQNLFRDRSGEEPEEMRASRFNAGRELRHGLDRRRVLRDDDFEVDEVTGISPARAHVAAANLVSAYEQTVKEERNFQKSFNNHVRTLIAREEVTLGLMHLWDLMEAITQNPTSKPLTAQLFLVVQHSRDNEAFREALLNITEPEGRWLYDLINILQSIIVQERSLGLAEKVAAINYSVLSLGKHYARKIYKTPYVPIDKEVKIDGFYMRMTLKVLTLSDDLGVYRNDRMHRAVSASRRRELSDRELMHSLQRALTGAGTEGENYFDMGADLQWQPSRRALDAAGYELPYIEEVDAGQDEEGEYLED

SEQ ID NO: 41 - protein, 516 aa, Ape adenovirus BZ34
MASRGGNQSSDRHREHTPERGRGSASHPPPRPDRSPSQSPPPLPPKRNTYRRVGSGSSTESQVVLVSETSRSSMSPERSSSPPPIPPKKKPRKTKHVPLQDISQDSEEEREEAELVAVGFSYPPVRITEKDGKRSVEKIDKDDPLAKVAAISVRNSMSLPLVSAWEKGMEVMAVLMEKYRLENDLRTSFKLMPEQHEQYKRICHQYVNEEHRGVPLTFTSNKTLSTMMGRFLQGLVHSYSEIAHNNWECTGCALWSHGCNDYEGKLKCLHGNIMIQKEHIIEMDVASENGQRALKENPERTKITQNRWGRSVVQIANNDARCCVNDAGCAANQFSSKSCGMFYTEGSKAQQAFKQYEAFMKAVYPGMRSDQAKMMLIPLRCDCNHKPGWVPAMGRQTCKMTPFSMANAEDLDVGIITDPTVLASVKYPSLMVFQCCNPVYRNSRAQSTGPNCDFKISAPDLLGALQLTRKLWSDILPDLPVPKLVIPEFKWQAQFQFRNVSLPAGHSDSRQNPFDF

SEQ ID NO: 42 - protein, 181 aa, Ape adenovirus BZ34
MEVWAILEDLRQTRQLLENASDGVSGLWRFWFGGDLARLVFRIKQDYRQEFEKLLDDCPGLFEALNLGHQAHFKEKVLSVLDFSTPGRTAAAVAFLTFIFDKWIPQTHFSKGYVLDFIAAALWRTWKARRMRTILDYWPVQPLGVAGILRHPPTMPAVLEEEHQEDNPRVGLDPPVEEAEE

SEQ ID NO: 43 - protein, 495 aa, Ape adenovirus BZ34
MDPTDPLQQGIRFGFHSSSFVENMEGSQDEDNLRLLASTASGRSRDPETPTDHASGFGGGAPRGQSESRPGPSGGGGGGVADLFPELRRVLTRSTTSGRDRGIKRERNPSGTNPRSELALSLMSRRRPETIWWHEVQNEGRDEVSILQEKYSLEQVKTCWLEPEDDWEVAIRNYAKIALRPDKLYRITKRINIRNACYISGNGAEVVIDTQDRTVFRCCMMGMWPGVVGMEAVTLMNVKFRGDGYNGVVFMANTKLILHGCSFFGFNNICVEAWGQVSVRGCSFYACWIATSGRTKSQLSVKKCMFERCNLGILNEGEARVSHCASSETGCFILIKGNANVKHNMICGPSDERPYQMLTCAGGHCNMLATVHIVSHPRKKWPVLEHNVMTKCTMHVGGRRGMLMPYQCNMNNVKVMLEPDAFSRMSLTGIFDMNLQIWKILRYDDTKSRVRACECGGKHARFQPVCVDVTEELRPDHLVIACTGAEFGSSGEETD

SEQ ID NO: 44 - protein, 105 aa, Ape adenovirus BZ34; identical to SEQ ID NO: 10

SEQ ID NO: 45 - protein, 135 aa, Ape adenovirus BZ34
MTDPLAASAADKELLDIDGRASEQRLAQLRIRQQQERAAKELRDAIEIHQCKKGIFCLVKQAKISYEITANDHRLSYELGPQRQKFTCMVGINPIVITQQAGDTKGCIHCSCESTECIYTLLKTLCGLRDLLPMN

SEQ ID NO: 46 - protein, 148 aa, Ape adenovirus BZ34
MKAFAVLFVLSLIKTELRLAFGLPLLQPGLYNTSQTLRSSQKTQTLPLIQDFNSTSPAPSPTNLPDTNNLGAQLQHRFSRSLLSANTTTPRTGGELRGLPTDNPWVVAGFVALGVVAGGLVLILCYLYTPCCAYLVVLCCWFKKWGSY

SEQ ID NO: 47 - protein, 177 aa, Ape adenovirus BZ34
MASALFILAIITVISAQTIVDIPIGSNYTLIGPTTYTEVIWCRLSTEDYYNVFCDGDDDIQVTCDKQNLTLINVTQSYSGYFYGYDRYSSEFKNYMVRIIQPINANTKMEKLHMNNTLNLTISPTTPSEQNIPNSMIAIIVAVAVGMAIIIACMLIYACCYKKFRREKQDPLLNYDF

SEQ ID NO: 48 - protein, 188 aa, Ape adenovirus BZ34
MIYTVLTIFSLISASYGRTHVTLTAGSKYTLKGPDGHNGVIWWRIFDDGGFVNPCSTSNRYSCNGKDLTIINATKSDNGYYYGTNYITSLDYTITVISPTTPSPHKTTTFSSSSTITTTKIKTTSNIEHVQKMASNSTLPATNEIPKSIIGIIVAAIVGLSIIISCIIYYACCYRKIEKGDPLLSFDI

SEQ ID NO: 49 - protein, 170 aa, Ape adenovirus BZ34
MGVVLVSLALLSLLGLGSANLPDHDPCLDFDPENCTLTFAPETSRFCGVLIRCGRECRPIEITHNNKTWNNTLFTIWQPGDPQWYTVSVRGPDGSVRMANNTFIFAEMCDMAMFMSRQYDLWPPSKENIVAFSIAYCLGTCIITAIMCVCIHVLIAIRPRNSNEEKEKMP

SEQ ID NO: 50 - protein, 91 aa, Ape adenovirus BZ34; identical to SEQ ID NO: 16

SEQ ID NO: 51 - protein, 304 aa, Ape adenovirus BZ34
MSGSSSITTRSRARSTLCARHHPYTREPQLRAPLPRCEESETRASMTEEHPLLPDCNTLTMHSVSYVRGLPCSATFTVLQELPIPWDMFLTPEELRVMRRCMHLCLCCATIDIFYSQVIHGREKWVLHCHCNRQGSLQCIAGGAVLAIWFRKVIRGCMINQRCPWYREIVNMHMPKEIMYVGSVFWRGRHLIFIRIWYDGHAGQIIPEMSFGWSAFNYGLLNNIVVMCCTYCCDLSEIRMRCCAHRTRMLMLRAIRIMLRETVDPDPISSSRTERRRQRLLRGLMRHNRPIPFSDYDSHRSSSR

SEQ ID NO: 52 - protein, 124 aa, Ape adenovirus BZ34
MAAEALYVILEGPGARLPVQEGNNYIFYAPVDFTLHPRGVALLHLRLSIIVPRCYLGRFFSLTDTNTSGLYASSQIIYAGHQQPLSVMLFNHTDRFYEGRAGDPVACLVLERVIYPPVRQYSVM

SEQ ID NO: 53 - protein, 129 aa, Ape adenovirus BZ34
MLERSAITYCICIPQALNVHLADFSIINCIREALPDYLSSTLDDITGGSQYAYCNLTFAGGNWGGMRLFCTVASPALIPGGPMAKQFGDDMQEYLQLELREELRASGIPFDIAILNLLQVTEEHDILSL

SEQ ID NO: 54 - protein, 117 aa, Ape adenovirus BZ34; identical to SEQ ID NO: 20

SEQ ID NO: 55 - protein, 127 aa, Ape adenovirus BZ34
MVLPCLPPPPLVETQANCIAWLGIALSTVNDFIRAVRYDGVFMTTEAEDLLTNLREWLYYNYHTERARRRDRRRRDVCCAKTRFCYAKYENVRKQLHYNEVAGTLDIVRQTPSLHQGTSTEGPFTTL

SEQ ID NO: 56 - protein, 321 aa, Ape adenovirus BZ34
MAKRARLSSSFNPVYPYEDESSSQHPFINPGFISPDGFTQNSDGVLTLKCTAPLTTTGGSLQLKVGRGLTVDTTDGTLEEDIHILAPLTKTAHSIGLSLGNGLELKDSKLYVKLGDGLKFNSNSICLDHDINTLWTGMNPSINCNIMQQDDNDSKLTLVLTKNGGMVNAYVSLVGASDIVNSLFTRATANITIRLSFDASGNLLTSLSDLKTPLNHRYGNDMDTVTLTNGKSFMPSTTAYPFNDTTRDKENYIYGTCYYKSTEDALYPLEVAVTLNRRMSSAAVSYAMTIAWTLSANTPPETTIATLVTSPFTFSYIREND

SEQ ID NO: 57 - protein, 955 aa, Ape adenovirus BZ34
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGTAYNSLAPKGAPNTSQWLDKGVTTTDNTENGDEEDEVAEEGEEDKQATYTFGNAPVKAEAEITKEGLPIGLEVPSEGDPKPIYADKLYQPEPQVGEESWTDTDGTDEKYGGRALKPETKMKPCYGSFAKPTNVKGGQAKVKKVEEGKVEYDIDMNFFDLRSQKTGLKPKIVMYAENVDLETPDTHVVYKPGASDASSHANLGQQSMPNRPNYIGFRDNFIGLMYYNSTGNMGVLAGQASQLNAVVDLQDRNTELSYQLLLDSLGDRTRYFSMWNQAVDSYDPDVRVIENHGVEDELPNYCFPLDGVGPRTDSYKGIETNGDENTTWKDLDPNGISEIAKGNPFAMEINLQANLWRSFLYSNVALYLPDSYKYTPTNVTLPENKNTYDYMNGRVVPPSLVDTYVNIGARWSLDAMDNVNPFNHHRNAGLRYRSMLLGNGRYVPFHIQVPQKFFAVKNLLLLPGSYTYEWNFRKDVNMVLQSSLGNDLRVDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYVPEGYKDRMYSFFRNFQPMSRQVVDEINYKDYKAVAVPYQHNNSGFVGYMAPTMRQGQAYPANYPYPLIGTTAVTSVTQKKFLCDRTMWRIPFSSNFMSMGALTDLGQNLLYANSAHALDMTFEVDPMDEPTLLYLLFEVFDVVRVHQPHRGVIEAVYLRTPFSAGNATT

SEQ ID NO: 58 - protein, 449 aa, Ape adenovirus BZ34
METKGGRRSAAVLDQQDEPEAHPRKRTTRRAPIHRDGNNPDSDAATMEGSDTGSAGRPSSDTLLQEPPQSAKRGGLLDRDAIEHITELWDRLELLQQTLSKMPMADGLKPLKNFSSLQELLSLGGERLLTDLVRENIHVREMMNEVAPLLREDGSCRSLNYHLQPVIGVIYGPTGCGKSQLLRNLLSSQLITPAPETVFFIAPQVDMIPPSELKAWEMQICEGNYAPGPEGTFIPQSGTLRPKFIKMAYDDLSQEHNYDVSDPRNVFARAAAHGPIAIIMDECMENLGGHKGVSKFFHAFPSKLHDKFPKCTGYTVLVVLHNMNPRRDLGGNIANLKIQSKMHIISPRMHPSQLNRFVNTYTKGLPVAISLLLKDIVQHHALRPCYDWVIYNTTPEHEALQWSYLHPRDGLMPMYLNIQSHLYRVLEKIHRVLNDRDRWSRAYRARKIK

SEQ ID NO: 59 - protein, 138 aa, Ape adenovirus BZ34
MSGSASFEGGVFSPYLTGRLPPWAGVRQNVMGSTVDGRPVQPANSSTLTYATLSSSPLDAAAAAAASAAANTVLGIGYYGSIVANTSSSNNPSTLAEDKLLVLLAQLEALTQRLGELSQQVAQLREQTESAVATAKSK

SEQ ID NO: 60 - protein, 563 aa, Ape adenovirus BZ34
MMRRTVLGGAVVYPEGPPPSYESVMQQAAAAAMQPPLEAPFVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEYMFSNKFKARVMVSRKAPEGVTVDDNYDHKQDILEYEWFEFTLPEGNFSATMTIDLMNNAIIDNYLEVGRQNGVLESDIGVKFDTRNFRLGWDPETKLIMPGVYTYEAFHPDIVLLPGCGVDFTESRLSNLLGIRKRHPFQEGFKILYEDLEGGNIPALLDVEAYENSKKEQEAKTEAAKAAAIAKANIVVSDPVRVANAEEVRGDNYTASSVATEESLLAAVAETETTETKLTIKPVEKDSKSRSYNVLEDKVNTAYRSWYLSYNYGDPEKGVRSWTLLTTSDVTCGAEQVYWSLPDMMQDPVTFRSTRQVSNYPVVGAELMPVFSKSFYNEQAVYSQQLRQSTSLTHVFNRFPENQILIRPPAPTITTVSENVPALTDHGTLPLRSSIRGVQRVTVTDARRRTCPYVYKALGIVAPRVLSSRTF

SEQ ID NO: 61 - protein, 587 aa, Ape adenovirus BZ34
MEQQAPDPAIRAALQSQPSGINSSDDWSQAMQRIMALTTRNPEAFRQQPQANRLSAILEAVVPSRSNPTHEKVLAIVNALVENKAIRPDEAGLVYNALLERVARYNSSNVQTNLDRMVTDVREAVSQRERFQRDANLGSLVALNAFLSTQPANVPRGQQDYTNFLSALRLMVAEVPQSEVYQSGPDYFFQTSRQGLQTVNLSQAFKNLNGLWGVRAPVGDRATVSSLLTPNSRLLLLLVAPFTDSGSIDRNSYLGYLLNLYREAIGQTQVDEQTYQEITQVSRALGQEDTGSLEATLNFLLTNRSQKIPPQYALTAEEERILRYVQQSVGLFLMQEGATPTAALDMTARNMEPSMYASNRPFINKLLDYLHRAAAMNSDYFTNAILNPHWLPPPGFYTGEYDMPDPNDGFLWDDVDSSVFSPPPGYNTWKKEGGDRRHSSVSLSGATGAAAAVPEAASPFPSLPFSLNSVRSSELGRITRPRLIGEEEYLNDSLLRPEREKNFPNNGIESLVDKMNRWKTYAHDHRDDPRALGDSRGSATRKRQWHDRQRGLVWADEDSADDSSVLDLGGSGGNPFAHLRPRVGRLM

SEQ ID NO: 62 - protein, 1195 aa, Ape adenovirus BZ34
MALVQAHGSGSFHPEAADPRRQPPRRCARKSSQGAVPEPTRTRRRRATAGHATGARAAPTARRSPSPPILNMQEATEPPPLPPKRKNKGTVVAPKGHGTLQAIDISTNGPVEIKYHLNLPHALEKILQVNLQSLPTNLTPQRLRTLDSSGLRALVLELRPSRAEIWTCLPRGLVSMTTIETEDGQADANNIVEHEVQTPGLNFPLKFLVKGNQVQLIHEVHPVQRCEYCGRLYKHKHECSARRREFYFHHINSHSSNWWQEIQFFPIGSHPRTERLFLTYDVETYTWMGSFGKQLVPFMLVMKLSGDERLVNIAYDLAMKLKWDRWQQDPKTFYCVTPEKMAVGQHFRQYRDQLQTALAVDLWSSFMNANPHLHEWALEHYALSDPTDLTFEELKKLPHIRGSPRFIEMYIVGHNINGFDEIVLAAQVINNRAEVPQPFRITRNFLPRAGKILFNDVTFALPNPAYKKRVDFQLWEQGTCDDIDFKYQFLKVMVRDTFALTHTSLRKAAQAYSLPVEKGCCPYKAVNQFYMLGSYRADKDGFPLEEYWKDREEYLLNRELWEKKNQPGYDIIKETLDYCAMDVLVTAELVAKLQESYAHFIRDSVGLPHAHFNIFQRPTISSNSHAIFRQIVYRAEKPNRTNLGPGLLAPSHELYNYVRASIRGGRCYPTYIGILEEPLYVYDICGMYASALTHPMPWGTPLNPYERALAAREWQMALDDPTPISYFDKDLLPGIFTMDADPPDELMLDPLPPFCSRKGGRLCWTNEPLRGEVATSVDLITLHNRGWQVRIVPDELTTIFPEWKCLAREYVQLNIAAKERADKEKNQTMRSIAKLLSNALYGSFATKLDNKKIVFSDQMDESLMKGISAGTVNIKSSSFLETDNLSAEVMPAFEREYLPQQLALLDSDPEDSEDEQRPAPFYTPPAGTPGHVAYLYKPITFLDVEEGDMCLHTVEKVDPLVDNDRYPSQVASFVLAWTRAFVSEWSGFLYEEDRGTPLEDRPIKSVYGDTDSLFVTQRGHELMETKGKKRIKKYGGKLVFDPDEPDLTWLVECETVCASCGADAYSPESIFLAPKLYALKCLYCPSCHKTSKGKLRAKGHAAEALNYELMVNCYLADMQGADRQRFSTSRMSLRRTLASAQPGAHPFTVTETTLTRTLRPWKDRTLAALDAHRLIPYSRSRPNPRNEEVCWIEMP

SEQ ID NO: 63 - protein, 208 aa, Ape adenovirus BZ34
MACGSGNGSSEQELKAIVRDLGCGPYFLGTFDKRFPGFMAPNKLACAIVNTAGRETGGEHWLAFGWNPRSNTCYLFDPFGFSDDRLKQIYQFEYEGLLRRSALATKDRCITLEKSTQTVQGPRSAACGLFCCMFLHAFVHWPDRPMDGNPTMKLLTGVPNSMLQSPQVQPTLRRNQEALYHFLNTHSSYFRSHRARIERATAFDRMGY

SEQ ID NO: 64 - protein, 661 aa, Ape adenovirus BZ34
MALSINDCARLTGQTVPTMNYFMPLRNIWNRVREFPRASTTASGITWMSRYIYGYHRLMLEDLAPGAPATERWPLYRQPPPHFLIGYQYLVRTCNDYIFDTRAYSRLKYTELVRPGHQTVNWSVMANCSYTINTGAYHRFVDFDDFQATLTQVQQAILAERVVADLALVQPMRGFGLTRMHGRAGEEEVPVERLMQDYYKNLARCQDNAWGMANRLRIQQAGPKDLVLLATIRRLRTAYFNFITSSIVSPSQEEEGEERENPDRACSHPRQQETVLSLPCDCDWLDAFVERFSDPVDLETIRSLRGVPTGQLIKCIISALSLPNGEPPSHHFREMRGGVFTLRPRENGRAVTETMRRRRGEVIERFIDRLPVRRRRRRVPPPPPPPPPEEEEEMLVEEELEEEEEIPGAFEREVRATIAELIRLLEEELTVSARNSQFFNFAVDFYEAMERLEALGDVSEMPLRRWIMYFFVTEHIATTLNYLYQRLCNYAVFTRHVELNLAQVVMRARDPEGAVVYSRVWNEAGMNAFSQLMARISNDLAATVERAGRGDLQEEEIEQFMAEIAYQDNSGDVQEILRQAAVNDTEIDSVELSFRFKLTGPVAFTQRRQIQDVNRRVVAHASLLRAQYQNLPARGADVPLPAMPPGPEPPLPPGARPRHRF

SEQ ID NO: 65 - protein, 250 aa, Ape adenovirus BZ34
MEDINFSSLAPRHGTRPYMGTWSDIGTSQLNGGAFNWSSIWSGLKNFGSTIKTYGNKAWNSSTGQALRNKLKEQNFQQKVVDGIASGINGVVDLANQAVQKQINSRLDPPPSATGEMEVEEDLPPLEKRGDKRPRPDLEETLVTRSDDPPSYEEAVKLGMPTTRPVAPMATGVMKPSQSHRPATLDLPPPPTAAAPARKPVATPKPTTVQPVAVARPRPGGTPRPNANWQSTLNSIVGLGVQSVKRRRCF

SEQ ID NO: 66 - protein, 192 aa, Ape adenovirus BZ34
MSILISPSNNTGWGLRAPSKMYGGARKRSTQHPVRVRGHFRAPWGALKGRTRTRTTVDDVIDQVVADARNYTPTAPTSTVDAVIDSVVADARAYARRKSRRRRIARRHRATPAMRAARALLRRAKRVGRRAMLRAARRAASGASAGRSRRRAATAAAAAIANMAQPRRGNVYWVRDATTGQRVPVRTRPPRS

SEQ ID NO: 67 - protein, 227 aa, Ape adenovirus BZ34
MSKEIPTPYMWSYQPQMGLAAGASQDYSTRMNWLSAGPSMISRVNDIRAYRNQLLLEQSALTTTPRQHLNPRNWPASLVYQETPAPTTVLLPRDAQAEVQMTNAGVQLAGGSALCRHRPQQSIKRLVIRGRGIQLNDESVSSSLGLRPDGVFQIAGCGRSSFTPRQAVLTLESSSSQPRSGGIGTLQFVEEFTPSVYFNPFSGSPGQYPDEFIPNFDAISESVDGYD

SEQ ID NO: 68 - protein, 76 aa, Ape adenovirus BZ34
MALTCRLRVPITGYRGRNSRRRRGMLGRGMRRHRRRRAISKRLGGGFLPALIPIIAAAIGAIPGIASVAVQASQRH

SEQ ID NO: 69 - protein, 134 aa, Ape adenovirus BZ34
MQAILPVILILLLPCVALAPVTTRTPPEQLRKCKFQQPWSFLDCYQEKSDFPTYWIVIVGIINILSCTLFSFLIYPIFNFGWNVPNALAHPQNPEEHIPLQNMQQPLDLIDYENEPQPPLLPAISYFNLTGGDD

SEQ ID NO: 70 - protein, 353 aa, Ape adenovirus BZ34
MSKRKYKEEMLQVIAPEIYGPPVKDEKKPRKIKRVKKDKKEEDGNDGLVEFVREFAPRRRVQWRGRKVRPVLRPGTTVVFTPGERTSTAFKRSYDEVYGDDDILEQAADRLGEFAYGKRSRSSPKEEAVSIPLDNGNPTPSLKPVTLQQVLPVPPRRGNKREGEDLYPTMQLMVPKRQRLEDVLEKMKVDPDIQPEVKVRPIKQVAPGLGVQTVDIKIPTESMEVQTEPAKPTTTSIEVQTDPWMSAPVTAQAAVNTTRRSRRKYGPASLLMPNYALHPSIIPTPGYRGTRYYRSRSSTSRRRRKTPASRSHRRRRRPASNLTPAALVRRVYRDGRADPLTLPRVRYHPSITT

SEQ ID NO: 71 - DNA, 35179 bp, Ape adenovirus AH29
catcatcaataatataccttataaatggatcggtgccaacatgcaaatgagcttttgaaaatggagggcggaaggggattggctacagggttcaacggtcaaaaggggcgggccggcgcggggaggtgacgtgtttagtgtgggaggagttatgttgcaagttctcgcggtaaatgtgacgtaaaacgaggtgtgctttgaacacggaagtggacagttttcccgcgctgactgacaggatatgaggtagttttgggcggatgcaagtgaaaattctccattttcgcgcgaaaactgaatgaggaagtgaatttctgagtaatttcgagtttatgacagggcggagtatttaccgagggccgagtagactttgaccgattacgtggaggtttcgattaccgtgtttttcacctaaatttccgcgtacggtgtcaaagtcctgtgtttttacgtaggcgtcagctgatcgctagggtatttaaacctgacgagttccgtcaagaggccactcttgagtgccagcgagaagagatttctcctccgcgccgcgagtcagatctccactttgaaaaaaaatgagacacctgcgattcctgcctcaggaaatctccattgagaccggggatgaaatactgcagtttgtgataaatgccctgatgggagacgatccggagccgcctgcgcagcctttcgatcctcctacgcttcatgaactgtatgatttagaggtagacgggccggaggatcctaacgaggaagctgtgaatgggtttttcagcgattctatgctattagctgctagtgaaggagtggacttagacccaccttctgagacccttgataccccaggggtggtggtggaaagcggcagaggtgggaaaaaattgcctgaacttggtgctgctgaaatggatttgcactgttatgaagagggctttcctccgagtgatgatgaagatgaggaaaatgtgcagtcgatccagaccgcagcgggtgagggaataagagctgccaatgatggttttaagttggactacccggagctgcctggacatggctgtaagtcttgtgaatttcacaggaatagtactggactaaaagaactgttgtgctcgctttgctatatgagaacgcactgccattttatttacagtaagtgtgtttaacttaaatttaaagggacagtgtagcagtgttaataactgtgaatgtgggatttatgtttttgcttgtgattttttataggtcctgtgtctgatgctgatgaatcgccttctcctgattcaactacctcacctcctgaaattcaggcgccagtccctgcaaacatatgcaagcccattcctgtgaaggctaagcctgggaaacgccctgctgtggataagctggaggacttgcttgagggtggggatggacctttggacttgagtacccggaaactgccaaggcaatgagtgccctgcacctgtgtttatttaatgtgacgtcagtatttatgtgagagtgccatgtaataaaattatgtcagctgctgagtattttattgcttcttgggtggggacttggatatataagtaggagcagacctgtgtggttagctcacagcagcttgctgccatccatggaggtttgggctatcttggaagatctcagacagactaggcaactgctagaaaacgcctcggacggagtctctagtctttggagattctggttcggtggtgatctagctaggctagtctttagggtaaaacgggagtatagtgaagaatttgaaaagttattggaagacagtccaggactttttgaagcccttaacttgggccaccaggctcattttaaggagaaggttttatcagttttagatttttctacccctggtagaactgctgctgctgtagctttccttacttttatattggataaatggatcccacaaacccacttcagcaagggatacgtcttggatttcatagcagcagctttgtggagaacatggaaggcccgcaggctgaggataatcttagattactggccagtgcagcctctgggcgtagcggcaatcctgagacacccaccagtcatgccagcggttttggaggaggagcagcaggaggacaacccgagagccggcctggaccctccggcggaggaggcggaggagtagctgacctgtttcctgaactgcgacgggtgcttactaggtctacgtccagtggacaggacaggggcattaagagggagaggaatgctagtgggcataattcaagaactgagttggctttaagtttaatgagtcgcagccgccctgaaactatctggtggcatgaggttcagagcgagggcagggatgaagtttcaatattgcaggaaaaatattctctagaacaaattaaaacctgttggttggaacctgaggatgattgggaggtggccattaggaattatgctaagatatctctgaggcctgataaacagtataaaattaccaaaaagattaatatcagaaatgcatgctacatagcagggaatggggccgaggttataatagatacaccagataaaacagcttttaggtgttgcatgatgggtatgtggccaggggtggctggcatggaggcagtgacccttatgaatataaggtttaggggagatgggtataatgggattgtctttatggctaacactaaattaattctgcatggttgtagcttttttgggtttaataatacttgtgtggaatcttggggacaagtcagtatcaggggttgtagtttctatgcatgctggtttgcactatcaggcagaaccaagagtcagttgtctgtgaagaaatgcatgttcgagagatgtaacctgggcatactgaatgaaggtgaagcaagggtccgccactgcgctgctacagaaactggctgcttcattctaataaagggaaatgccagtgtgaagcataacatgatctgtggaccctcggatgagaggccttatcagatgctgacctgtgctggaggacattgcaatatgctggctaccgtgcatattgtttctcatgcacgcaagaaatggcctgtgtttgagcataatgtgatgaccaagtgcaccatgcacataggtggtcgcaggggaatgtttatgccttaccagtgtaacatgaatcatgtgaaggtgatgttggaaccagatgccttttccagaatgagcttaacaggaatctttgatatgaatgtgcaactatggaagatcctgagatatgatgagaccaaatcgagggtgcgcgcatgcgaatgcgggggcaagcatgccaggttccagccggtgtgtgtggatgtgacggaagacctgagacccgatcatttggtgcttgcctgcactggagcggagttcggttctagtggggaagaaactgactaaagtgagtagtggggaatgctttggaggggattccaggcgggtaaggtgggcagattgggtaaattctgtttgtttctgtcttgcagctgccatgagtggaagcgcttcttttgaggggggagtctttagcccttatctgacggggcgactcccaccctgggcaggagttcgtcagaatgtcatgggatccactgtggatgggagacccgtccagcccgccaattcctcaacgctgacctatgccactttgagctcttcacccttggatgcagccgcagccgctgccgcctctgctgccgccaacactgtccttggaatgggctattatggaagcatcgttgccaattccagttcctctaataacccttcgaccctggctgaggacaagctacttgtcctcttggctcagctcgaggccttgacccagcgcctaggcgaactgtctcagcaggtggcccagttgcgcgagcaaactgagtctgctgttgccacagcaaagtctaaataaagattcccaaatcaataaataaaggagatccttgttgattgtaaaacaagtgtaatgaatctttatttgatttttcgcgcgcggtatgccctggaccaccggtctcgatcattgagaactcggtggatcttttccaggaccctgtagaggtgggattgaatgtttagatacatgggcattaggccgtctcgggggtggagatagctccattgaagagcctcatgctccggggtagtgttataaatcacccagtcataacaaggtcggagtgcatggtgttgcacaatatcttttaggagcaggctaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgtccgcccagattctccatgcactcatccataatgatagcgatgggaccgtgggcggcggcgcgggcaaacacgttccgggggtctgacacatcatagttatgctcctgagtcaggtcatcataagccattttaataaacttggggcggagggtgccagattgggggatgaaagttccctcgggccccggagcatagtttccctcacatatttgcatttcccaagctttcagttcagagggggggatcatgtccacctgcggggctataaaaaataccgtttctggagccggggtgattaactgggatgagagcagattcctgagcagctgagacttgccgcacccagtgggaccgtaaatgaccccgattacgggttgcagatggtagtttagggagcggcagctgccgtcctcccggagcaggggggccacttcgttcatcatttcccttacatggatattttcccgcaccaagtccgttaggaggcgctctccccccagggatagaagctcctggagcgaggagaagtttttcagcggcttcagcccgtcagccatgggcattttggagagagtctgttgcaagagctctagtcggtcccagagctcggtgatgtgttctatggcatctcgatccagcagacctcctcgtttcgcgggttgggacgactcctggagtatggtatcagacgatgggcgtccagcgctgccagggtccgatctttccagggtcgcagcgtccgagtcagggttgtttccgtcacggtgaaggggtgcgcgcctggttgggcgcttgcgagggtgcgtttcaggctcatcctgctggtcgagaaccgctgccgatcggcgccctgcatgtcggccaggtagcagtttaccatgagttcgtagttgagcgcctcggccgcgtggcctttggcgcggagcttacctttggaagttttctggcaggcggggcagtacagacacttgagggcatacagtttgggagcgaggaagatggattcgggggagtatgcgtccgcaccgcaggaggcgcagacggtttcgcattccacgagccaggtcagatccggctcatcggggtcaaaaacaagttttcccccatgttttttgatgcgtttcttacctttggtctccatgagttcgtgtccccgctgggtgacaaagaggctgtccgtgtccccgtagaccgattttatgggcctgtcctcgagcggagtgcctcggtcctcttcgtagaggaactcggaccactctgatacaaaggcgcgcgtccaggccagcacaaaagaggccacgtgggaggggtagcggtcgttgtcaaccagggggtccaccttctccacggtatgtaaacacatgtccccctcctccacatccaagaatgtgattggcttgtaagtgtatgccacgtgaccaggggtccccgccgggggggtataaaagggggcgggtctctgctcgtcctcactgtcttccggatcgctgtccaggagcgccagctgttggggtaggtattccctctcgaaggcgggcataacctctgcactcaggttgtcagtttctaggaacgaggaggatttgatattgacagtgccagccgagatgcctttcataagactctcgtccatttggtcagaaaatacaatctttttgttgtccagcttggtggcaaaggatccatagagggcattggataagagcttggctatggagcgcatggtttggttcttttccttgtcagcgcgctccttggcagcaatgttgagctggacatactcgcgcgccagacacttccattcagggaagatggttgtcagttcatctggtacgattctgactcgccagcccctgttatgcagggtgatcagatccacactggtggtcacttcgcctctgaggggctcgttggtccagcatagtcgacccccttttctcgaacagaaaggtgggagggggtctagcatgagttcatcaggggggtctgcatccatagtgaagattcctgggagcagatccttgtcaaaatagctgatgggtgtggggtcatccaaagccatctgccattctcgagctgccagcgcgcgctcataggggttgagaggggtgccccatggcatggggtgggtgagtgcagaggcatacatgccacagatgtcatagacatagaggggctcttcgaggatgccaatgtaggtgggataacagcgcccccctctgatgcttgctcgcacatagtcatagagttcatgcgagggggcgagcagacccgagcccaaattagtgcgattgggtttttcagccctgtagacgatctggcgaaagatggcatgtgaatttgaagagatggtgggtctctgaaagatgttaaaatgggcatgaggtagacctacagagtccctgatgaagtgggcatatgactcttgcagcttggccaccagctctgcagtgacaaggacatccaaggcgcagtagtcaagggtctcttggatgatgtcataacctggttggtttttcttttcccacagctcgcggttgagaaggtattcttcgcgatccttccagtactcttcgaggggaaacccgtctttgtctgcacggtaagagcccagcatgtagaactgattaactgctttgtagggacagcatcccttctccacggggagagagtatgcttgggctgccttgcgcagtgaggtatgagtgagggcgaaggtgtccctgaccatgactttgaggaactggtgcttgaaatcgatgtcatcacaggccccctgttcccagagttggaagtccacccgcttcttgtaggcggggttgggcaaagcgaaagtaacatcattgaagagaatcttgccggccctgggcatgaaattgcgggtgatgcggaaaggctggggcacctctgcccggttattgatcacctgagcggctaggacgatctcgtcaaagccattgatgttgtgtcccacaatgtaaagttctatgaatcgcggggtgcccctgacatgaggcagcttcttgagttcttcaaaagtgaggtctgtagggtcagagagagcatagtgttcgagggcccattcgtgcaggtgagggtttgcattgaggaaggaggaccagagatccactgccagtgctgtttgtaactggtctcggtactggcgaaaatgctggccgactgccatcttttctggggtaatacagtagaaggttttggggtcttgctgccagcgatcccacttgagtttgatggcgaggtcgtaggcgatgttgacgagccgctcgtcccccgaaagtttcatgaccagcatgaatgggatcagctgcttgccaaaggaccccatccaggtgtaggtttccacatcgtaggtgaggaagagcctttctgtgcgaggatgagagccgatcgggaagaactggatctcctgccaccagttggaggaatggctgttgatgtgatggaagtagaactccctgcggcgcgccgagcattcatgcttgtgcttgtacagacggccacagtactcgcagcgcttcacgggatgcacctcatgaatgagttgtacctggcttcctttgacgagaaatttcagtgggaagttgaggcctggcgcttgtacctcgcgctctactatgttatctgcatcggcctggccatcttctgtctcgatggtggtcatgctgacgagcccccgcgggaggcaagtccagacctcggcgcgggaggggcggagctcgaggacgagagcgcgcaggccggagctgtccagggtcctgagtcgctgcggagtcaggttagtaggtagtgtcaggagattaacttgcatgatcttttcgagggcatgcgggaggttcagatggtacttgatctccacgggtccgttggtggtgatgtcgatggcttgcagggtcccatgccccttgggcgccaccaccgtgcccttgtttttccttttgggcggcggtggctctgttgcttcttgcatgttcagaagcggtggcgagggcgcgcgccgggcggtaggggcggctctggccccggcggcatggctggcagaggcacgtcggcgccgcgcgcgggtaggttctggtactgcgccctgagaagacttgcgtgcgcgacgacgcggcggttgatgtcctggatctgacgcctctgggtgaaagctaccggacccgtgagcttgaacctgaaagagagttcaacagaatcaatttcggtatcgttgacggcggcttgcctcaggatctcttgcacgtcgcccgagttgtcctggtaggcgatctcggccatgaactgctcgatttcttcctcctgaagatctccgcggcccgctctctcgacggtggccgcgaggtcgttggagatgcgacccatgagttgagagaatgcattcatgcccgcctcgttccagacgcggctgtagaccacggccccctcgggatctcttgcgcgcatgaccacctgggcgaggttgagctccacgtggcgggtgaagaccgcatagttgcataggcgctggaagaggtagttgagtgtggtggcgatgtgctcggtgacgaagaaatacatgatccatcgtctcagcggcatctcgctgacatcgcccagggcttccaagcgttccatggcctcgtagaagtccacagcgaagttgaaaaactgggagttgcgcgcggacacggtcaactcctcctccagaagacggatgagttcggcgatggtggcgcgcacctcgcgctcgaaggcccccgggatttcttcctcctcctcttcttctatctcttcttccactaacatctcttcttcctcttcaggcgggggcggaggaggagggggcgcgcggcgacgccggcggcgcacgggcagacggtcgatgaatctttcaatgacctctccgcggcggcggcgcatggtctcggtgacggctcggccgttctccctgggtctcagagtgaagacgcctccgcgcatctccctgaagtggtgactggggggctctccgttgggcagggacagggcgctgatgatgcattttatcaattgccccgtagggactccgcgcaaggacctgatcgtctgaagatccacgggatctgaaaacctttcgacgaaagcgtctaaccagtcgcaatcgcaaggtaggctgagcactgtttcttgcgggcgggggtggctagatgctcggtcggggttctctcttccttctccttcctcatcatctcgggagggtgagacgatgctgctggtgatgaaattaaaataggcagttctgagacggcggatggtggcgaggagcaccaggtctttgggtccggcttgctggatgcgcaggcgatcggccattccccaagcattatcctggcatctggccagatctttatagtagtcttgcatgagtcgctccacgggcacttcttcttcgcccgctctaccatgcatgcgcgtgagcccgaacccgcgcatgggctggacaagtgccaagtccgctacgaccctttcggcgaggatggcttgctgcacctgggtgagggtggcttggaagtcgtcaaagtccacgaagcgatggtaggccccggtgttaatggtgtaggagcagttggccatgactgaccagttgactgtctggtgccccgggcgcacgatctcggtgtacttgagtcgcgagtaggcgcgggtgtcaaagatgtaatcgttgcaggtgcgcaccaaatactggtagccgatgagaaagtgcggcggtggctggcggtagaggggccatcgctctgtagccggggctccgggggcgaggtcttccagcatgaggcggtggtatccgtagatgtacctggacatccaggtgatcccggaggcggtggtggacgcccgcgggaactcgcgcactcggttccagatgttgcgcagcggcatgaagtagttcatggtaggcacggtctggccagtgaggcgggcgcagtcattgatgctctatagacacggagaaaacgaaagcgatgagcggctcgcctccgtggcctggaggaacgtgaacgggttgggtcgcggtgtaccccggttcgagacacaagccaagcgagcacaactcgggccggccggagccgtggctaacgtggtattggcgatcccgtctcgacccagccgacgaatatccaggatacggagtcgagtcgttttgctgcttgttgcttttcctggacgggagccagcgccgcgtcaagctttagaacgctcagttcacggggccgggagtggctcgcgcccgtagtctggagaatcaatcgccagggttgcgttgcggtgtgccccggttcgagccttagcgtggcccggatcggccggtttccgcggcaagcgagggtttggcagcctcgtcatttctaagaccccgccagccgacttctccagtttacgggagcgagccctcttttttttttgttttgtcgcccagatgcatcccgtgctgcgacagatgcgcccccagcaacaggccccttctcagcaacagcagcagccacaaaaggctcttcctgctcctgctcctgcaactactgcagtcgcagccgtgtgcggcgcgggacagcccgcctatgatctggacttggaagagggcgagggactggcgcgtctgggtgcaccatcgcccgagcggcaccctcgagtgcaactgaaaaaggactctcgcgaggcgtacgtgccccagcagaacctgttcagggacaggagcggcgaggagcccgaggagatgcgagcctctcgctttaacgcgggtcgcgagctgcgccacggtctggaccgaagacgggtgctgcgggacgaggatttcgaggtcgatgaagtgacagggatcagccccgctagggcacatgtggccgcggccaacctcgtctcggcctacgagcagaccgtgaaggaggagcgcaacttccaaaaatctttcaacaaccatgtgcgcaccctgatcgcccgcgaggaagtgaccctgggtctgatgcacctgtgggacctgatggaagctatcacccagaaccccactagcaaacccctaaccgctcagctgtttctggtggtgcaacatagcagggacaatgaggcattcagggaggcgctgctgaacatcaccgagcccgaggggagatggttgtatgatctgatcaatatcctgcagagtattatagtgcaggaacgcagcctgggtctggccgagaaagtggcagctattaactactcggtcttgagcctgggcaagtattacgctcgcaagatctacaagaccccctacgtgcccatagacaaggaggtgaagatagatgggttttacatgcgcatgactcttaaggtgctgactctcagtgacgatctgggggtgtaccgcaacgacaggatgcaccgcgcggtgagcgccagcaggaggcgcgagctgagcgacagggaacttatgcacagcttgcaaagagctctgacgggggcagggaccgatggggagaactactttgacatgggggcagacttgcaatggcagcctagccgccgggccctggacgcggcagggtgtgagcttccttacgtagaagaggtggatgaaggcgatgaggaggagggcgagtacctggaagactgatggcgcgacccgtatttttgctagatggaacagcaggcaccggaccccgcaatgcgggcggcgctgcagagccagccgtccggcattaactcctcggacgattggacccaggccatgcaacgcatcatggcgctgacgacccgcaaccccgaagcctttagacagcaaccccaggccaatcgcctttcggccatcctggaggccgtagttccttcccgctccaaccccacccacgagaaggtcctggccatcgtgaacgcgctggtggagaacaaggccatccgtcccgatgaggccgggctggtatacaatgccctcttggagcgcgtggcccgctacaacagcagcaacgtgcagaccaacctggaccggatggtgaccgatgtgcgcgaggcagtgtctcagcgcgagcggttccagcgcgatgccaacttggggtcgctggtggcgctgaacgccttcctcagcacccagcctgccaacgtgccccgcggccagcaagactatacaaactttctaagtgcactgagactcatggtaaccgaagtccctcagagcgaggtgtaccagtccggaccagactacttcttccagaccagcagacagggcttgcagacagtaaacctgagccaggctttcaagaacctcagagggctgtggggagtgcacgctccggtaggagatcgtgcgaccgtgtctagcttgctgacccccaactcccgcctactgctgctgctggtatcccccttcactgacagcggtagcatcgaccgcaactcctacttgggctacctgttgaacttgtatcgtgaggccatagggcagagccaggtggacgagcagacctaccaagaaatcacccaagtgagccgcgccctgggtcaggaagacacgggcagcttggaagccaccctgaactttttgctgaccaaccgatcgcagaagatccctcctcagtatgcgcttaccgcggaggaggagcggattctgagatatgtccagcagagcgtgggactgttcctgatgcaggagggggcgacccctagtgccgcgctggacatgacagcgcgaaacatggagcccagcatgtatgccagtaaccggcctttcatcaacaaactactggattacctgcacagggcagccgccatgaactctgattatttcaccaatgctatcctcaacccccactggctgcccccgcctggattttacacgggcgagtatgatatgcccgaccctaatgacgggtttctgtgggacgacgtggacagcagcatattctccccgcctcctggttataacacttggaaaaaggaagggggcgatagaagacactcttccgtgtcgctgtccggatcgaggggtgctgctgctgcggtgcccgaagctgcaagtcctttccctagcctgccattttctctgaacagtgtgcgcagcagtgaactggggagaataactcgcccgcgcttaatgggcgaggatgagtacttgaacgactccttgcttagacccgagagggaaaagaacttccccaacaatgggatagagagcctggtggataagatgagtagatggaagacttatgcacaggatcacaaagacgagcctaggatcttgggggctgcgagcgggacgacccgtagacgccagcgccatgacagacagaggggtcttgtatgggacgatgaggactcggccgatgacagcagcgtgttggacttgggtgggagaggagggggcaacccgttcgctcatctgcgcccgcactttggacgcatgttgtaaagtgaaagtaaaaataaaaaaaggcaactcaccaaggccatggcgacgagcgtgcgttcgttcttttctgttatctgtgtctagtatgatgaggcgagccgtgctaggcggagcggtggtgtatccggagggtcctcctccttcgtacgagagcgtgatgcagcagcaggcggcggcggtaatgcagtcctcgctggaggctccctttgtacccccgcggtacctggcgcctacagaggggagaaacagcattcgttactcggagctggcaccccagtacgataccaccaggttgtatctggtggacaacaagtcggcggacatcgcctcattgaactatcagaacgaccacagcaacttcctgaccacggtggtgcagaacaatgactttacccccacggaggccagcacccagaccatcaactttgacgagcggtcgcggtggggcggtcagctgaagaccatcatgcacaccaacatgcccaacgtgaacgagtacatgttcagcaacaaattcaaggcgcgggtgatggtgtccagaaaggctcctgaaggtgttacagtagatgacaaatatgatcataagcaagatatcttgaagtatgagtggtttgagttcactttaccagaaggcaacttttcagccaccatgaccattgacctgatgaacaatgccatcatcgataactacctggaaattggcagacagaatggagtgctggaaagtgacatcggcgtcaagtttgataccaggaacttcaggctgggctgggacccagaaactaagttaatcatgcctggggtttacacctatgaggccttccatcctgacattgtgctactgcctggttgcggggtggacttcactgagagtcgccttagcaacttgcttggcatcaggaagagacacccattccaggaaggctttcagatcatgtatgatgatctcgaagggggtaatatccccgccattctggatgtagaaacctatgaaaaaagcaaaaaggaaaatgcaagcgccactactactactactgcagtaacaactgatgcaagaatggttgctgaaacttcagctgaagcggcagttgcagtagtagtagatactattaaggaacaaaatgacagtgtgcccagaggtgataattaccaatctgctaaagacatgaaagcatctgatgaaacagctgtggtggtggtgccggttgtgcctggtgtagtaactgaaactgaaaccaaatcaccaactattcagccgctaaaaaaagatagcaaaagtaggagttataatgtcttggaagatgaagtcaacacagcctatcgcagttggtacctgtcctacaactatggcgaccctgaaaaaggagtccgctcctggacactgctcaccacttcagatgtcacctgcggagcggagcaagtctattggtcgctccctgacatgatgcaggacccggtcacctttcgctctacgagacaagtcagcaactaccccgtggtgggtgcagagctcatgcccgtcttctcaaagagtttctacaacgagcaagccgtgtactcccagcagctccgccagaccacctcgctcacgcacgtcttcaatcgcttccctgagaatcagatcctcatccgcccgccggcgcccaccattaccaccgtcagtgaaaacgttcctgctctcacagatcacgggaccctgccgttgcgcagcagtatccggggagtccagcgcgtgaccgttactgacgccagacgccgcacctgcccctacgtctacaaggccctgggcatagtcgcgccgcgcgtcctttcaagccgcactttctaaaaaaatgtccattctcatctcacccagtaataacaccggttgggggctacgcacacccaccaggatgtacggaggcgctcgcaaacggtctacccagcaccctgtgcgtgtgcgcgggcatttccgcgctccctggggcgccctcaagggccgcgctcgcactaggaccaccgttgatgatgtgatcgaccaggtggttgcagatgctcgtaattatactcctgctgcccctgcatctactgtagatgcagttattgacagcgtggtggctgacgctcgcgactatgctcgccggaagagcaggcgaagacgcattgccaggcgccaccgggctacccccgccatgcgagctgcaagagctctgctgcggagagccaaacgcgtggggcgaagagccatgcttagagcggccagacgcgcggcttcaggtgccagcgcaggcaggtcccgcaggcgcgcggccacggcggcagcagcggccattgccaacatggcccaaccgcgaagaggcaatgtgtactgggtgcgcgatgccactaccggtcagcgcgtgcccgtgcgcacccgtccccctcgcacttagaagatactgagcagtctccgatgttgtgtcccagcggcgaggatgtccaagcgcaaatacaaggaagagatgctccaggtcatcgcgcctgaaatctacggtccaccggtgaaggatgaaaaaaagccccgcaaaatcaagcgggtcaaaaaggacaaaaaggaagaagatgacgatgatgggctggtggagtttgtgcgcgagttcgctccaaggcggcgcgtgcagtggcgcgggcgcagggtgcagccggtgttgagacccggaaccacggtggtcttcacgcccggcgagcgctccagcactacttttaaacgctcctatgatgaggtgtacggggatgatgatattctggagcaggcggccgaccgcctgggcgagtttgcttatggcaaacgcagccgctccaatcctaaagaggaggcggtgtccatccccttggatcatggaaatcccaccccaagtctaaaaccagtcaccctgcagcaagtgctgcccgtacctccacggagaggtgttaagcgagaaggcgaggatctgtatcccactatgcaattgatggtgcccaagcgccagaagctggaggacgtgctggagaaaatgaaagtggatcccgatatccagcctgaagttaaagtgagacccatcaagcaggtggcgcccggtctgggagtacaaaccgtggacatcaagattcccaccgagtccatggaagtccagactgaacctgcaaagcccgcagccacctccattgaggtgcagacggatccatggatgcccgcgcccattgcaaccgacgccagtaccgttcgaagaccccggcgaaagtatggtccagcgagtctgctgatgccaaactatgctctgcacccatccattattccaactccgggctaccgaggcactcgctactaccgcagccggagtactacttcccgccgtcgcaaaacacctgcaagccgcagtcgccgtcgccgccgccgcaccaccagcaaactgacccccgccgctctggtgcggagggtgtatcgcgatggccgcgcagagcccctgatgctgccgcgcgcacgctaccatccaagcatcaccacttaatgactgttgccgctgcctccttgcagatatggccctcacttgccgcctccgcgtccccattactggctaccgaggaagaaactcgcgccgtagaaggatgttgggtagcgggatgcgtcgccacaggcggcggcgcgctatcagcaagaggctggggggtggctttctgaccgctttgattcccatcatcgccgcggcgatcggggcggtaccaggcatagcttccgtggcggttcaggcctcgcagcgccactgacattggaaaaaacttataaataaaatagaatggactctgacgctcctggtcctgtgactatgtttttgtagagatggaagacatcaatttttcatccctggctccgcgacacggcacgaggccgtacatgggcacctggagcgacatcggcaccagccaactgaacgggggcgccttcaattggagcagtatctggagcgggcttaaaaattttggctctaccataaaaacctatgggaacaaagcttggaacagcagcacagggcaggcgctgaggaataagcttaaagagcagaacttccagcagaaggtggtcgatggtatcgcctctggtatcaatggggtggtggatctggccaaccaggccgtgcagaaacagataaacagccgcctggacccgccgcctgcagcccatggtgaaatggaagtggaggaagagctccctcccctggaaaagcggggagacaagcgcccgcgtcccgatatggaggagactttggtgacgcgcggagacgagccgcctccatacgaggaggcaataaagcttggaatgcccactaccaggcctatagctcccatggccaccggggtaatgaaaccttctcagtcgcatcgacccgccaccttggacttgcctcctgcccctgctgctgcagcgcccgctccaaagcctgtcgctaccccgaagcccaccgccgtacagcccgtcgccgtagccagaccgcgtcccgggggcactccgcgcccgaatgcaaactggcagagtactctgaacagcattgtgggtctgggcgtgcagagtgtaaagcgccgtcgctgctattaattaaatatggagtagcgcttaacttgcttgtctgtgtgtatgtgtcatcaccacgccgccgcagcagcagaggagaaaggaagaggtcgcgcgccgaggctgagttgctttcaagatggccaccccatcgatgctgccccagtgggcatacatgcacatcgccggacaggatgcttcggagtacctgagtccgggtctggtgcagttcgcccgcgccacagacacctacttcaatttggggaacaagtttaggaaccccaccgtggcccccacccacgatgtgaccaccgaccgaagccagcggctgatgctgcgctttgtgcccgttgatcgggaggacaatacctactcttacaaagttcgctacacactggctgtgggcgacaacagagtgctggatatggccagcaccttctttgacatccggggggtgcttgacagaggtcccagtttcaagccatactctggcacagcttacaactcactagctcctaaaggcgctcccaacacttgtcagtggaagtacaaaacacttgctaacacagaaacagaagaagaggaggaggaggacaaacaggcagatgaacaagaatacgttgaaaagacttctacatttggaaatgcgcctgtaaaaggactggatatagatgcagatggcttgcagataggtgtggacatacaagatgaaactaaaccagtctacgctaacaagctttatgaaccagaaccccaagtgggagatggacaatggcatgataccactgctattactgagcagtatggaggccgtgctcttaagcctgacacaaaaatgaaaccttgctatggatcgtttgctagacctacaaatgaaaaaggaggacaatctaaaactagatcagtaacgaaggatgacaaagtagtggaagagccagatattgatatggctttctttgatggaagagatgccaaaaaaccagatccagaaattgttctgtatactgaaaatgttaacttggaaacacctgacactcatatcgtttacaaagccggcacagatgattccagctcatctattaatttgggccaacagtctatgcccaatagacccaactatattggcttcagagacaacttcattgggctcatgtactataacagtactggcaatatgggagtgttggccggacaagcatcccagctaaatgcagtggttgacttgcaggacagaaacacagagctgtcttaccagcttttgcttgattctttgggagacaggactagatactttagcatgtggaatcaggcagtggacagctatgaccctgatgtccgtattattgaaaaccatggtgtggaagacgaacttcccaattactgtttcccattggatggagtgggtcgcacagatacttacaaaggcgtcgtagtagatcaagctgcagcagcagaaactgcaactacttggaaagatgataccactgcaaatgaatacaatgaaattgctaagggtaataatctagccatggaaattaatctccaagctaacttatggagaagttttctttactccaatgtagctttgtaccttccggatgcttacaaatacactccggctaatgtcactctccctactaacactaatacctatgaatacatgaatgggagggtagtgtcgccatctttggtggacgcttatgtaaacattggcgcaagatggtctttggatcctatggacaatgttaacccctttaatcatcaccgcaatgctggcctgcgctatcggtcaatgcttctgggcaacggtcgctatgtgcccttccacatccaagtgcctcagaaattttttgctgtgaaaaacctgcttctcctcccaggctcctacacctatgagtggaactttcgcaaggatgtaaatatggtcttgcaaagttctcttggcaacgacctcagaacagatggtgctaccatcagttttaccagcattaatctctatgccaccttcttccccatggctcacaacactgcttccactcttgaagccatgctgcgcaatgacaccaatgaccagtcattcaatgactacctctctgcagctaacatgctctacccaattccagcaaatgccaccaacattcccatttccattccctctcgcaactgggctgccttcaggggctggtccttcaccagactcaaaactaaggagactccctctttgggatcaggctttgatccctactttgtttattctggctctattccctacctggatggtaccttctacctcaaccacactttcaagaaggtgtccatcatgtttgactcctcagttagctggcctggcaatgacagattgctaactccaaatgagtttgaaatcaagcgcactgtggatggagaagggtacaatgtggctcaatgcaacatgaccaaggactggttcctggttcagatgcttgccaactacaacattggctaccagggcttctacatcccagaggggtacaaggatcgcatgtactccttcttcagaaacttccagcccatgagtaggcaggtggttgatgagatcaactacactgactacaaggctgttaagcttccattccaacacaacaactctggatttgtgggttacctcgctccaaccattcgtcagggtcaagcttatccagctaactacccataccccctaattggatccactgctgttaaaagcgttacccagaaaaagttcctgtgcgacaggaccatgtggcgcatccccttctccagcaacttcatgtccatgggtgcccttaccgacctggggcagaacatgctttatgccaactcagcccatgcgctggacatgacttttgaggtggatcccatggatgagcccacactgctttatcttctttttgaagtcttcgacgtggtcagagtgcaccagccacaccgcggcgtcatcgaggctgtctacctgcgtaccccgttctcagctggtaacgccaccacataagaagcttcttgcttcttgcaagcagctgccatggcctgtgggtccggcaatggatccagcgagcaagagctcagggccattgctagagacctgggctgcggaccctatttccttggaacctttgataaacgcttcccggggttcatggcccccgacaagctcgcctgtgccattgttaacacggcaggtcgcgagacggggggtgaacattggctggcttttggttggaatccgcgctccaacacctgctacctttttgatccttttggcttctcggatgagcgcctcaagcaaatctaccagtttgagtatgaggggcttctgcgtcgcagtgccctagctaccaaggaccgctgtataaccctggaaaagtccacccaaaccgtgcagggcccgcgctccgcagcctgtggacttttttgctgcatgttcctccacgcttttgtgcactggcccgaccgtcccatggacggaaaccccaccatgaagttactgacgggggtgcccaacagcatgctccaatcgccccaagtccagcccaccctgcgccacaaccaggaggcgctctaccgcttcctaaactcccactcatcttactttcgttctcaccgcgcgcgcattgaaaaggccaccgcgtttgaccgtatggatatgcaataacaagtcatgtaaaccgtgtttcaaataaacagcactttattttttacatgcactgtggctctgggttgctcattcattcatcattcactcagaagtcgaaggggttttggcgggaatcagagtgacccgcgggcagggatacgttgcggaactggaacctgttctgccacttgaactcggggatcaccagcttgggaactggaatctcggggaaggtgtcttgccacagctttctggtcagttgcagagcgccgagcaggtcaggagcagagatcttgaaatcacagttggggccggcattttgggtgcgggagttgcggtacactgggttgcagcactggaacaccatcagggcggggtgtcttacgctcgccagcacggtcgggtcactgatggtagacacatccaagtcttcagcattggccattccaaagggggtcatcttacaggtctgtctgcccatcacgggagcgcagccgggcttgtggttgcaatcgcagtgaatggggatcagcatcatcctggcctggttgggggttatccctggatacaccgccttcataaaggcttcgtactgcttgaaagcttcctgggccttgcttccctcggtgtagaacatcccacaggacttgctggaaaactgattagtagcacagttggcatcattcacacagcagcgggcatcgttgttggccagctggaccacattcctgccccagcggttctgggtgatcttggctcggtctgggttctccttcatcgcgcgctgcccgttctcgctcgccacatccatctcgatgatgtgatccttctggatcatgatagtgccatgcaggcatttcaccttgccttcataatcggtgcagccatgagcccacagagcgcacccggtgcattcccaattgttgtgggcgatctccgaatatgaatgcaccaatccctgcaggaatcttcccatcatcgcagtcagagtcttcatgctagtaaaggtcagcggaatacctcggtgctcctcgttcacatactggtggcagatacgcctgtactgctcgtgctgctcgggcatcagcttgaaagaggttctcaggtcattatccagcctatacctctccatcagtacggccattacttccatgcccttctcccaggcagagaccaagggcaggctcatgggattcctaacagcaatagaactagcagctgcagctcctttagccagagggtcaatcttgtcaatcttctcaacacttctcttgccatccttctcagtgatgcgcacgggtgggtagctgaagcccacggccaccagctccgcctgttctctttcttcttcgctgtcctggctgatgtcttgcagagggacatgcttggtcttcctgggcttcttcttgggagggatcgggggagggctgttgctccgctccggagacagggaggaccgcgaagtttcgctcaccagtaccacctggctctcggtagaagaaccggaccccacacggcggtaggtgttcctcttcgggggcagaggtggaggcgactgcgatgggctgcggtccggcctgggaggcggatggctggcagagcctcttccgcgttcgggggtgtgctcccggtggcggtcgcttgactgatttcctccgcggctggccattgtgttctcctaggcagagaaacaacagacatggagactcagccatcgctgccaacaccgctgcaagcgccatcacacctcgcccccagcagcgacgaggaggaacagagcttaaccaccccaccacccagtcccgccaccaccacctctaccctcgatgaggaggaggaggtcgacgcaccccaggagatgcaggatatggaggatgagaaagcggaagagattgaggcagatgtcgagcaggacccgggctatgtgacaccggcggagcacgaggaggagctgagacgctttctagacagagaggataacaaccgcccagagcagcaagcagatggcgatcaccaggaggctgggctcggggatcatgtcgccgactacctcaccgggcttggcagggaggacgtgctcctcaaacatctagcaaggcagtcgatcatagttaaagacgctctgctcgaccgcagcgaagtgcccatcagtgtggaagagctcagccgcgcctacgagctcaacctgttctcgcctcgggtgccccccaagcgtcagccaaacggcacctgcgagcccaaccctcgcctcaacttctatccggcctttgctgtcccagaagtgctggctacctaccacatctttttcaagaaccaaaagattccagtctcctgccgtgccaaccgcacccgcgccgatgccctgctcaacttgggaccgggcgctcgcttacctgatatagcttccttggaagaggttccaaagatcttcgagggtctgggcagtgatgagactcgggccgcaaatgctctgcaacagggagagaatggcatggatgaacatcacagcgctctggtggagttggagggagacaatgcccggcttgcagtgctcaagcgcagtatcgaggtcacccattttgcctaccccgctgtcaacctgccccccaaagtcatgagcgctgtcatggaccagctgctcatcaagcgagcaagccccctttccgaagaccagaacatgcaggatccagacgcctctgacgagggcaagccggtggtcagtgacgagcagctgtctcgctggctgagtactaactccccacgagacttggaagagaggcgcaagcttatgatggctgtagtgctagtcactgtggagctggagtgtctccgccgctttttcaccgaccctgagaccctgcgcaagctcgaggagaacctgcactatactttcagacatggtttcgtgcgccaggcatgcaagatctccaacgtggagctcaccaacctggtctcctacatgggcattttgcatgagaaccgcctggggcagagcgtgttgcataccaccctaaaaggggaggtccgccgcgactacatccgcgactgtgtctacctctacctctgccatacctggcagactggcatgggtgtatggcagcagtgtttggaagagcagaacctgaaagagctggacaagctcttgcagagatcccttaaagccctgtggacaggttttgacgagcgcaccgtcgcctcagacctggcagacatcatctttcccgagcgtctcagggttactctgcgcaacggcctgcctgacttcatgagccagagcatgcttaacaactttcgctttttcatcctggaacgctccggtatcctgcccgccacctgctgcgcgctgccctccgactttgtgcctctcacctaccgcgagtgccccccgccgctatggagccactgctacctgttccgcctggccaactacctctcctaccactcggatgtgatcgaggatgtgagcggagacggcctgctggagtgccactgccgctgcaatctctgcacaccccaccgttcccttgcctgcaacccccagttgctgagcgagactcagatcatcggcaccttcgagttgcagggtcccagcagtgaaggcgaggggtcttctccggggcagagtctgaaactgaccccggggctatggacctccgcctacctgcgcaagttcgcccccgaagactaccacccctatgagatcaggttctatgaggaccaatcacagccgcccaaagccgagctctcagcctgcgtcatcactcagggggcaattctcgcccaattgcaagccatccaaaaatcccgccaagaatttctgctgaaaaaggggaacggggtctacctcgacccccagaccggtgaggagctcaacacaaggttccctcaggatgtcccagcgccgaggaagcaagaagttgaaggtgcagctgccgcccccagaggatatggaggaagactgggacagtcaggcagaggaggaggagatggaagattgggacagccaggcagaggaggcggacagcctggaggaagacagtttggaggaggaagacgaggaggcagaggaggtggaagaaacaaccgccgccaaacaattgtcctcggcagcggagacaagcaaggccccagacagcagcagcacggctacaatctccgctccgggtcggggggcccagcagcgtcccaacagtagatgggacgagaccgggcgattcccgaacccgaccaccgcttccaagaccggtaagaaggagcggcagggatacaagtcctggcgggggcataagaatgccatcatctcctgcttgcatgaatgcgggggcaacatatccttcacccggcgctacctgctcttccaccacggggtgaacttcccccgcaatgtcttgcattactaccggcacctccacagcccctactacagccagcaagtcccgacagcctcggcagagaaagacagcagcagcagcggggacctccagcagaaaaccagcagcagcagttagaaaatccagtgcagcaggaggaggactgaggatcacagcgaacgagccagcgcagacccgagagctgagaaacaggatctttccaaccctctatgccatcttccagcagagtcgggggcaagagcaggaactgaaagtaaaaaaccgatctctgcgctcgctcacccgaagttgtttgtatcacaagagcgaagaccaacttcagcgcactcttgaggacgccgaggctctcttcaacaagtactgcgcgctgactcttaaagagtagcccgcgcccgcgctagctcgaaaaaggcgggaattacgtcacccttggcacctgtcctttgccctcgtcatgagtaaagaaattcccacgccttacatgtggagctatcagccccaaatgggactggcagcaggcgcctcccaggactactccacccgcatgaattggctcagcgccggcccctcgatgatctcacgggttaatgatatacgagcttaccgaaaccagttactcctagaacagtcagctctcaccaccacaccccgccaacaccttaatccccggaattggcccgcctccctggtgtaccaggaaactcccgctcccaccaccgtactacttcctcgagacgcccaggccgaagttcagatgactaacgcaggtgtacagctggcgggcggttccgccctgtgtcgtcaccggcctcagcagagtataaaacgcctggtgatcagaggccgaggtatccagctcaacgacgagtcggtgagctcttcgcttggtctgcgaccagacggagtcttccagatcgccggctgtgggagatcttccttcactcctcgtcaggctgtcctgactttggagagttcgtcctcgcagccccgctcgggcggcatcgggactctccagtttgtggaggagtttactccctctgtctacttcaaccccttctccggctctcccggccagtacccggacgagttcataccgaacttcgacgcaatcagcgagtcagtggatggctatgattgatgtctggtggcgcggctgagttagctcgactgcgacatctagaccactgccgccgctttcgctgtttcgcccgggaactcaccgagttcatctacttcgaactccccgaggagcaccctcagggaccggcccacggagtgcggattaccatcgaagggggaatagactctcgcctgcatcggatcttctgccagcgacccgtgctgatcgagcgcgaccagggaactacaacagtctccatctactgcatctgtaaccaccccggattgcatgaaagcctttgctgtcttatttgtgctgagtttaataaaaactgagttaagactcacctttggactaccgcttcttcaacccggactttacaacaccagccagaccctccgttccagccagaagacccagacccttcctctgatccaggactctaattctacctccccagcgcctttccctactaaccttcccgttactaacaacctcggagctcagctgcaacaccgcttctccagaagcctcttttctgccaatactactactcccagaaccggaggtgagctccgtggtctccctactgacaacccctgggtggtagcgggttttgtagcgctaggagtagttgcgggtgggctggtgcttatcctctgctacctatacacaccttgctgtgcttatttagtagtattgtgttgctggtttaagaaatgggggtcgtactagtagcgctcactttactttcgcttttgggtctgggctctgctcatctcattcctcccaatcacgatccatgtctggactttgatccagagaactgcacaatcacttttgcacctgaaacaagtcgcttctgtggagttgttattaggtgcggattcgaatgcaggcccattgagattacacacaataacaaaacttggaacaataccttattcaccacatggtctccaggagatcctcagtggtatactgtctctgtccgggatcctgacggttccgtccgcatggctaataacacttttatttttgctgaaatgtgcgatatggtcatgttcatgagcaagcagtatgacctatggcctcccagcaaggagaacattgtggcattctccatcgcttattgcttgtgtacttgcatcatcactgctatcatgtgtgtgtgcatacacttgcttatagccattcgccccaaaaacagcaatgaggaaaaagaaaaaatgccctaactcttactttttgtttacagcatgacttctatcacacttttccttattactattagctttactgtagttcacacacaaagacaagtttcggcagtcataggatcaacttgtaccctagtaggtcccgaaaattctccatctgttagttggctaagacttcgcaatagtgaatggtttacattttgtcacctacccgtaagaaaaccttcatatagctgcgattcccaaaatctaacacttattaatatcacaaaaaatgatgagggctattattatgtatataacaacaaaaacctgcacaacatagtttataagctttctgtaaccattcctactacaccagcaccgcctaaaacacgtaaaactacacgctcaattaaaacttccaaaattgacagctccacaatagaagtcaaactaaacaaacaagctttaacattttcccaactacaaaaccttaatgacacagtaaattctaccttgcccgctcttccaaatgaaaacagaattccaaactcaatgattggaatcattgtggcggtggtaatgggaatgatcataatcataatatgtatgatcacctatgcttgctgctacagaaggtttcattatgaggaaaaaggagatcccctactaaattttgacatttaattttttatagatgatgaaaacactaggtatcttgattatttgctgctgcattaatttctctcaattaataccaacaccaactagcaacaatgtgcagactactttacagaacaccacaaacgaagctacctcagttttgctacttaataatacagaccttaatactaactcaatctctaaacattttcttcaacttcaaatcactgctcttattataattggattaataattctggcaatccttctatactttgtcttttgtcgcaacatccccaatgttcacaaacccattaaaaagcgtcctatttacaaccccatcttaagtgaaccacaacttagaaggtggagggaaatctaatacatctctcttttctttcagtatggtgatcaccaatcatgatccctagaaattttttcttcaccatactcatctgccttctcaatatctgcgctacccttgctgcggccactagcgtctcaccagactgcataggaccatttgccacctacttgctttttgcattgattacctgtatttgtgtgagtagcacagtctgtctggttattaattttttccaacttatagactggatttttgtgcgctttgcctacctgagacaccatccagaataccgcaaccatgatattgcggcactactcagacttctttaaaaccatacaggctttgctaccactgctactattgctgctactgccatgtgtcactatagccaccacacctaccctaaacccaaatcttagaaaatgtaaattccaagagccatggaatttcctcaaatgttataatgaaacaattgatttcccaccctattggataacaatcattggaatccttaatgtggtatgctgcaccatatttgcattccttgtatatcccatgtttgattttgggtggaatgtccccaatgcactcactcacccacaagaaccacaggaacatatcccactacaaaacatgcaaccactagcactaatagaatatgaaaatgagccacagcctccactactccctgccattagctacttcaacctaaccggtggagatgactgacccactcgccgcatccaccgctgccgaggaactacttgatatggacggccgtgcctccgaacagcgactcgcccaactacgcattcgccagcagcaggaacgtgccgccaaggagctcagggatgccattgtgattcaccagtgtaaaaaaggcatattctgcttggtaaaacaagccaagatctcctacgagatcaccgctaacgaccaccgtctctcatatgagcttggcccgcagcgtcagaaattcacttgcatggtgggaatcaaccccatagtcatcacccagcaagctggagataccaagggttgcatccattgttcctgcgaatccaccgagtgcatctacaccctgctgaagaccctctgcggtcttcgagacctactacccatgaactaatcaataacccctacccctttccatcaaacccaaaaaacaataaataaaaatcacttacttaaaatcagaaacaaggtttttgtccaagttgtttttaagcagcacctcacttccctcttcccaactctggtactctaagcctcggcgggtggcatacttcctccacactttgaaagggatgtcaaattttagttcttcgtctctacccataatcttcatctctatccccagatggccaaacgagttcggctgagcgactccttcaatccagtctatccatatgaagaggagaatacctcccactcctttataaaccctggctttatatcatcagacgggtttacacaaaacccacaaggtgtacttacacttaaatgcataactcctcttactaccacaggggggtctctccaactcaaagtgggcggtgggcttgcagtagacaacactgatggaacattagaagaagacataaccactatagctccaatttctaaaaataaacacactgtaggactatcaattggatatggtctacaaacacaggatagcaaattatgtgtaaatctgggcaacggtcttaaaattagtaacaacagtatttgcttagatcatgacatcaatactttatggactggcattaacccatcagcaaactgtcaaatcatgcacctagatgaaacaaatgatggcaaactcactttggtattagtaaaaaatggaggacttgttaatggatatgtatccttagtgggtgcatctgatactgttaatcaactgtttatgcgaaaaacagcaaacattcaagtgcgcttatactttaactcatctggcgccttacttacagacctatcagatttaaaaaattcccttaattataaatccgggccaaatatggctattggaacagtcaatgacaaaagctttatgcccagcattaaagcttaccctttcaataatgccaacaatggcaactacattcacggtacatgctactacatgaccagttatgacaaaagcctatttcctttaagtattgctgtgtggcttaatggacgtatgagtagtgccaatgtagcttatgcaatacaaatagactggactctaaactcagatcaagctccagaaactacacaggccacccttgttacctcccccttctccttttcctatattagagaagatgatgactgacaacaaaataaagttcaacttttttattgaaaaatcagtttacaggatacgagtagttattttgcctcccccttcccatttcatagaatacaccaatctctccccacgcacagctttaaacatttggattccatttgagatagtcatggatttggattccacattccatacagtttcagagctagataatcttggatcagtgatagagataaatccatcggggcagtcattcaaggtgatttcacagtccagttgctgaggatgcggctccggagtctggatcagagtcatctggaagaagaacgatgggagtcataatccgagaacgggatcggacggttgtgtctcatcaaaccccgaagcagtcgctgtctgcgtcgctccgtgcgactgctgctgatgggatcggggtccacagtctctcgaagcatgattctaatagccctcaacattaacattctggtacgatgcgcacagcagcgcatcctgatctcacttagctcacagcagtaggtacaacacaacaccacaatgttgtttaacaggccataattaaaggcactccagccaaaactcatttcaggaataatttgcccagcatgaccatcgtaccaaatcctgatgtaaatcagatggcggcccctccagaacacactgcccacatacatgatctccttaggcatatgcatattcacaatctctcggtaccatggacagcgctggttaatcatgcagccacgaatgaccttccggaaccaaatggccagcactgcgcccccagcaatacattgaagagaaccctgtcgattacagtgacaatggagaacccacttctctcgcccatggatcacttgggaataaaatatatctattgtggcacaacacagacataaatgcatacatcttctcatcacccttaactcctcaggggttaaaaacatatcccagggaataggaagctcttgcaaaacagtgaaggtggcagaacaaggcagaccgcgaacataacttacactgtgcatggtcaaggtgttacaatctggtaataacggatgctcctcagtcatagaagctctggtttcactttcctcacagcgtggtaaaggggccctcagttgaggttccctggtgtaaggatggtgtctggcgcacgatgtcgagcgtgcacgcgacctcgttgtaatggagctgcttcctgacattctcgtattttgcatagcagaacctagtcttggcacagcacacgtcccgtcgcctcctgtcccgccgcctagcacgttcagtgtggtaattatagtacagccattcccgtagattggtcaaaagatcttcagcctcagttgtcataaaaactccatcatatcttactgctctgataaaatcatttactgtagaaagtgcaatgcccagccaggcaatgcaattagcttgtgtttcgaccaaaggagggggaggaagacatggaagaaccataattaatttttattccagacgatcccgcagtatttctacatggagatcacgaagatggcacctctcgcccccactgtgttgatgaaaaatgacagctaggtcaaacataatgcgattttccaggtgctcaacggtggcttcaagcaaagcctccaaacgtacatccaaaaacaaaagaacagcaaaagcaggagcattttctaattcctcaatcatcatattacattcctgtaccattcccaaataattttcatctttccatccttgaattattcgtgttatttcatctggtaaatccaatccacacatgagaaatagctcccggagggcgccctccaccggcaatcttaagcacaccctcatagtgagaaaatatcgtgctcctctgtcacctgcagcaaattgagaatggcaatatcaaactgaatgccactggctctaagctcttctctaagttccagttgtaaatactctctcatatcatcgccaaactgcttggccataggtcctccaggaataagagcgggggacgctacagtgcagaacaagcgcatgccgccccaactgcctccagcaaaagtgaggttgcaatatgcatactgagaacctccagtgatatcatccagtgtactggaaagataatcaggcagagcttctcgtatgcaattaataatagaaaagtctgccagatgaacatttaaagcctgtgggatgcagatgcaataagttatcgcgctgcgctccaacattgttagtatggttagtctgtaaaaacaaaaaacaaaaaaaattacatcacgctatactggcgaacgggtggataaatcactctctccaacaccaggcaggctacagggtctccagcgcgaccctcgtaaaacctgtcagtatgattaaaaagcatcaccgaaagaggttgttgatggccagcatatattatttgcgatgaagcatacaaaccagaagtgttagtatcagttaaagaaaaaaatcggccaagatagcatctcggaacgattatgctcaatctcaaatgcagcaaagcgacacctcgcggatgcaaagtaaaatccacaggagcataaaaaatgtaattattcccctcttgcacaggcagcctagctcccggcccctccaaaatcacatacaaagcctcagcagtcatggcttaccgcgcaaatcaggcacagcagtcagataaagagaaagctgtgaactgactgcccagcctgtgcgcaatatatagagaacccttacactgacgtaattggacaaagtctaaaaaaacccgccaaaaaaccagcacacgcccaaaagtgtgtcacccgctaaaaaaataattttcacttcctcgttccgtatatgacgtcaattcctctttcccacgaatcgtcacttccggacatcttgcaacgtcacctccccgcgccggcccgccccttttgaccgttgaaccctgtagccaatccccttccgccctccattttcaaaagctcatttgcatgttggcaccgatccatttataaggtatattattgatgatg

SEQ ID NO: 72 - protein, 227 aa, Ape adenovirus AH35
MSKDIPTPYMWSYQPQMGLAAGASQDYSTRMNWLSAGPHMISQVNDIRTHRNQILVEQAAITTTPRNNPNPREWPASLVYQEIPGPTTVLLPRDSQAEVQMTNSGAQLAGGCRHRVRPPRQGITHLEIRGRGIQLNDESVSSSLGLRPDGTFQIAGAGRSSFTPRQAYLTLQSSSSAPRSGGIGTLQFVQEFVPSVYFNPFSGSPGRYPDQFIPNFDAARDSVDGYD

SEQ ID NO: 73 - protein, 831 aa, Ape adenovirus AH29
METQPSLPTPLQAPSHLAPSSDEEEQSLTTPPPSPATTTSTLDEEEEVDAPQEMQDMEDEKAEEIEADVEQDPGYVTPAEHEEELRRFLDREDNNRPEQQADGDHQEAGLGDHVADYLTGLGREDVLLKHLARQSIIVKDALLDRSEVPISVEELSRAYELNLFSPRVPPKRQPNGTCEPNPRLNFYPAFAVPEVLATYHIFFKNQKIPVSCRANRTRADALLNLGPGARLPDIASLEEVPKIFEGLGSDETRAANALQQGENGMDEHHSALVELEGDNARLAVLKRSIEVTHFAYPAVNLPPKVMSAVMDQLLIKRASPLSEDQNMQDPDASDEGKPVVSDEQLSRWLSTNSPRDLEERRKLMMAVVLVTVELECLRRFFTDPETLRKLEENLHYTFRHGFVRQACKISNVELTNLVSYMGILHENRLGQSVLHTTLKGEVRRDYIRDCVYLYLCHTWQTGMGVWQQCLEEQNLKELDKLLQRSLKALWTGFDERTVASDLADIIFPERLRVTLRNGLPDFMSQSMLNNFRFFILERSGILPATCCALPSDFVPLTYRECPPPLWSHCYLFRLANYLSYHSDVIEDVSGDGLLECHCRCNLCTPHRSLACNPQLLSETQIIGTFELQGPSSEGEGSSPGQSLKLTPGLWTSAYLRKFAPEDYHPYEIRFYEDQSQPPKAELSACVITQGAILAQLQAIQKSRQEFLLKKGNGVYLDPQTGEELNTRFPQDVPAPRKQEVEGAAAAPRGYGGRLGQSGRGGGDGRLGQPGRGGGQPGGRQFGGGRRGGRGGGRNNRRQTIVLGSGDKQGPRQQQHGYNLRSGSGGPAASQQ

SEQ ID NO: 74 - protein, 205 aa, Ape adenovirus AH29
MSQRRGSKKLKVQLPPPEDMEEDWDSQAEEEEMEDWDSQAEEADSLEEDSLEEEDEEAEEVEETTAAKQLSSAAETSKAPDSSSTATISAPGRGAQQRPNSRWDETGRFPNPTTASKTGKKERQGYKSWRGHKNAIISCLHECGGNISFTRRYLLFHHGVNFPRNVLHYYRHLHSPYYSQQVPTASAEKDSSSSGDLQQKTSSSS

SEQ ID NO: 75 - protein, 237 aa, Ape adenovirus AH29
MSQRRGSKKLKVQLPPPEDMEEDWDSQAEEEEMEDWDSQAEEADSLEEDSLEEEDEEAEEVEETTAAKQLSSAAETSKAPDSSSTATISAPGRGAQQRPNSRWDETGRFPNTTGTSTAPTTASKSRQPRQRKTAAAAGTSSRKPAAAVRKSSAAGGGLRITANEPAQTRELRNRIFPTLYAIFQQSRGQEQELKVKNRSLRSLTRSCLYHKSEDQLQRTLEDAEALFNKYCALTLKE

SEQ ID NO: 76 - protein, 389 aa, Ape adenovirus AH29
MHPVLRQMRPQQQAPSQQQQQPQKALPAPAPATTAVAAVCGAGQPAYDLDLEEGEGLARLGAPSPERHPRVQLKKDSREAYVPQQNLFRDRSGEEPEEMRASRFNAGRELRHGLDRRRVLRDEDFEVDEVTGISPARAHVAAANLVSAYEQTVKEERNFQKSFNNHVRTLIAREEVTLGLMHLWDLMEAITQNPTSKPLTAQLFLVVQHSRDNEAFREALLNITEPEGRWLYDLINILQSIIVQERSLGLAEKVAAINYSVLSLGKYYARKIYKTPYVPIDKEVKIDGFYMRMTLKVLTLSDDLGVYRNDRMHRAVSASRRRELSDRELMHSLQRALTGAGTDGENYFDMGADLQWQPSRRALDAAGCELPYVEEVDEGDEEEGEYLED

SEQ ID NO: 77 - protein, 520 aa, Ape adenovirus AH29
MASRGGNQSSDRHREHTPERGRGSASHPPPRPDRSPSQSPPPLPPKRNTYRRVGSGSSTESQVVLVSETSRSSLSPERSNSPPPIPPKKKPRKTKHVPLQDISQDSEEEREQAELVAVGFSYPPVRITEKDGKRSVEKIDKIDPLAKGAAAASSIAVRNPMSLPLVSAWEKGMEVMAVLMERYRLDNDLRTSFKLMPEQHEQYRRICHQYVNEEHRGIPLTFTSMKTLTAMMGRFLQGLVHSYSEIAHNNWECTGCALWAHGCTDYEGKVKCLHGTIMIQKDHIIEMDVASENGQRAMKENPDRAKITQNRWGRNVVQLANNDARCCVNDANCATNQFSSKSCGMFYTEGSKAQEAFKQYEAFMKAVYPGITPNQARMMLIPIHCDCNHKPGCAPVMGRQTCKMTPFGMANAEDLDVSTISDPTVLASVRHPALMVFQCCNPVYRNSRTQNAGPNCDFKISAPDLLGALQLTRKLWQDTFPEIPVPKLVIPEFKWQNRFQFRNVSLPAGHSDSRQNPFDF

SEQ ID NO: 78 - protein, 181 aa, Ape adenovirus AH29
MEVWAILEDLRQTRQLLENASDGVSSLWRFWFGGDLARLVFRVKREYSEEFEKLLEDSPGLFEALNLGHQAHFKEKVLSVLDFSTPGRTAAAVAFLTFILDKWIPQTHFSKGYVLDFIAAALWRTWKARRLRIILDYWPVQPLGVAAILRHPPVMPAVLEEEQQEDNPRAGLDPPAEEAEE

SEQ ID NO: 79 - protein, 495 aa, Ape adenovirus AH29
MDPTNPLQQGIRLGFHSSSFVENMEGPQAEDNLRLLASAASGRSGNPETPTSHASGFGGGAAGGQPESRPGPSGGGGGGVADLFPELRRVLTRSTSSGQDRGIKRERNASGHNSRTELALSLMSRSRPETIWWHEVQSEGRDEVSILQEKYSLEQIKTCWLEPEDDWEVAIRNYAKISLRPDKQYKITKKINIRNACYIAGNGAEVIIDTPDKTAFRCCMMGMWPGVAGMEAVTLMNIRFRGDGYNGIVFMANTKLILHGCSFFGFNNTCVESWGQVSIRGCSFYACWFALSGRTKSQLSVKKCMFERCNLGILNEGEARVRHCAATETGCFILIKGNASVKHNMICGPSDERPYQMLTCAGGHCNMLATVHIVSHARKKWPVFEHNVMTKCTMHIGGRRGMFMPYQCNMNHVKVMLEPDAFSRMSLTGIFDMNVQLWKILRYDETKSRVRACECGGKHARFQPVCVDVTEDLRPDHLVLACTGAEFGSSGEETD

SEQ ID NO: 80 - protein, 105 aa, Ape adenovirus AH29; identical to SEQ ID NO: 10

SEQ ID NO: 81 - protein, 135 aa, Ape adenovirus AH29
MTDPLAASTAAEELLDMDGRASEQRLAQLRIRQQQERAAKELRDAIVIHQCKKGIFCLVKQAKISYEITANDHRLSYELGPQRQKFTCMVGINPIVITQQAGDTKGCIHCSCESTECIYTLLKTLCGLRDLLPMN

SEQ ID NO: 82 - protein, 148 aa, Ape adenovirus AH29
MKAFAVLFVLSLIKTELRLTFGLPLLQPGLYNTSQTLRSSQKTQTLPLIQDSNSTSPAPFPTNLPVTNNLGAQLQHRFSRSLFSANTTTPRTGGELRGLPTDNPWVVAGFVALGVVAGGLVLILCYLYTPCCAYLVVLCCWFKKWGSY

SEQ ID NO: 83 - protein, 209 aa, Ape adenovirus AH29
MTSITLFLITISFTVVHTQRQVSAVIGSTCTLVGPENSPSVSWLRLRNSEWFTFCHLPVRKPSYSCDSQNLTLINITKNDEGYYYVYNNKNLHNIVYKLSVTIPTTPAPPKTRKTTRSIKTSKIDSSTIEVKLNKQALTFSQLQNLNDTVNSTLPALPNENRIPNSMIGIIVAVVMGMIIIIICMITYACCYRRFHYEEKGDPLLNFDI

SEQ ID NO: 84 - protein, 172 aa, Ape adenovirus AH29
MGVVLVALTLLSLLGLGSAHLIPPNHDPCLDFDPENCTITFAPETSRFCGVVIRCGFECRPIEITHNNKTWNNTLFTTWSPGDPQWYTVSVRDPDGSVRMANNTFIFAEMCDMVMFMSKQYDLWPPSKENIVAFSIAYCLCTCIITAIMCVCIHLLIAIRPKNSNEEKEKMP

SEQ ID NO: 85 - protein, 124 aa, Ape adenovirus AH29
MTAEALYVILEGPGARLPVQEGNNYIFYAPVDFTLHPRGVALLHLRLSIIVPRCYLGRFFSLTDTNTSGLYASSQIIYAGHQQPLSVMLFNHTDRFYEGRAGDPVACLVLERVIYPPVRQYSVM

SEQ ID NO: 86 - protein, 91 aa, Ape adenovirus AH29
MIPRNFFFTILICLLNICATLAAATSVSPDCIGPFATYLLFALITCICVSSTVCLVINFFQLIDWIFVRFAYLRHHPEYRNHDIAALLRLL

SEQ ID NO: 87 - protein, 143 aa, Ape adenovirus AH29
MILRHYSDFFKTIQALLPLLLLLLLPCVTIATTPTLNPNLRKCKFQEPWNFLKCYNETIDFPPYWITIIGILNVVCCTIFAFLVYPMFDFGWNVPNALTHPQEPQEHIPLQNMQPLALIEYENEPQPPLLPAISYFNLTGGDD

SEQ ID NO: 88 - protein, 304 aa, Ape adenovirus AH29
MSGSSSITTRSRARSTSCARHHPYTREPQLRAPLPRCEESETRASMTEEHPLLPDCNTLTMHSVSYVRGLPCSATFTVLQELPIPWDMFLTPEELRVMRRCMHLCLCCATIDIFYSQVIHGREKWVLHCHCNRQGSLQCIAGGAVLAIWFRKVIRGCMINQRCPWYREIVNMHMPKEIMYVGSVFWRGRHLIYIRIWYDGHAGQIIPEMSFGWSAFNYGLLNNIVVLCCTYCCELSEIRMRCCAHRTRMLMLRAIRIMLRETVDPDPISSSRTERRRQRLLRGLMRHNRPIPFSDYDSHRSSSR

SEQ ID NO: 89 - protein, 129 aa, Ape adenovirus AH29
MLERSAITYCICIPQALNVHLADFSIINCIREALPDYLSSTLDDITGGSQYAYCNLTFAGGSWGGMRLFCTVASPALIPGGPMAKQFGDDMREYLQLELREELRASGIQFDIAILNLLQVTEEHDIFSL

SEQ ID NO: 90 - protein, 117 aa, Ape adenovirus AH29
MRVCLRLPVEGALRELFLMCGLDLPDEITRIIQGWKDENYLGMVQECNMMIEELENAPAFAVLLFLDVRLEALLEATVEHLENRIMFDLAVIFHQHSGGERCHLRDLHVEILRDRLE

SEQ ID NO: 91 - protein, 127 aa, Ape adenovirus AH29
MVLPCLPPPPLVETQANCIAWLGIALSTVNDFIRAVRYDGVFMTTEAEDLLTNLREWLYYNYHTERARRRDRRRRDVCCAKTRFCYAKYENVRKQLHYNEVACTLDIVRQTPSLHQGTSTEGPFTTL

SEQ ID NO: 92 - protein, 320 aa, Ape adenovirus AH29
MAKRVRLSDSFNPVYPYEEENTSHSFINPGFISSDGFTQNPQGVLTLKCITPLTTTGGSLQLKVGGGLAVDNTDGTLEEDITTIAPISKNKHTVGLSIGYGLQTQDSKLCVNLGNGLKISNNSICLDHDINTLWTGINPSANCQIMHLDETNDGKLTLVLVKNGGLVNGYVSLVGASDTVNQLFMRKTANIQVRLYFNSSGALLTDLSDLKNSLNYKSGPNMAIGTVNDKSFMPSIKAYPFNNANNGNYIHGTCYYMTSYDKSLFPLSIAVWLNGRMSSANVAYAIQIDWTLNSDQAPETTQATLVTSPFSFSYIREDDD

SEQ ID NO: 93 - protein, 956 aa, Ape adenovirus AH29
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGTAYNSLAPKGAPNTCQWKYKTLANTETEEEEEEDKQADEQEYVEKTSTFGNAPVKGLDIDADGLQIGVDIQDETKPVYANKLYEPEPQVGDGQWHDTTAITEQYGGRALKPDTKMKPCYGSFARPTNEKGGQSKTRSVTKDDKVVEEPDIDMAFFDGRDAKKPDPEIVLYTENVNLETPDTHIVYKAGTDDSSSSINLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGVGRTDTYKGVVVDQAAAAETATTWKDDTTANEYNEIAKGNNLAMEINLQANLWRSFLYSNVALYLPDAYKYTPANVTLPTNTNTYEYMNGRVVSPSLVDAYVNIGARWSLDPMDNVNPFNHHRNAGLRYRSMLLGNGRYVPFHIQVPQKFFAVKNLLLLPGSYTYEWNFRKDVNMVLQSSLGNDLRTDGATISFTSINLYATFFPMAHNTASTLEAMLRNDTNDQSFNDYLSAANMLYPIPANATNIPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYIPEGYKDRMYSFFRNFQPMSRQVVDEINYTDYKAVKLPFQHNNSGFVGYLAPTIRQGQAYPANYPYPLIGSTAVKSVTQKKFLCDRTMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 94 - protein, 348 aa, Ape adenovirus AH29
MPMADGLKPLKNFSSLQELLSLGGERLLTDLVRENIHVREMMNEVAPLLREDGSCRSLNYHLQPVIGVIYGPTGCGKSQLLRNLLSSQLITPAPETVFFIAPQVDMIPPSELKAWEMQICEGNYAPGPEGTFIPQSGTLRPKFIKMAYDDLTQEHNYDVSDPRNVFARAAAHGPIAIIMDECMENLGGHKGVSKFFHAFPSKLHDKFPKCTGYTVLVVLHNMNPRRDLGGNIANLKIQSKMHIISPRMHPSQLNRFVNTYTKGLPVAISLLLKDIVQHHALRPCYDWVIYNTTPEHEALQWSYLHPRDGLMPMYLNIQSHLYRVLEKIHRVLNDRDRWSRAYRARKIK

SEQ ID NO: 95 - protein, 138 aa, Ape adenovirus AH29
MSGSASFEGGVFSPYLTGRLPPWAGVRQNVMGSTVDGRPVQPANSSTLTYATLSSSPLDAAAAAAASAAANTVLGMGYYGSIVANSSSSNNPSTLAEDKLLVLLAQLEALTQRLGELSQQVAQLREQTESAVATAKSK

SEQ ID NO: 96 - protein, 580 aa, Ape adenovirus AH29
MMRRAVLGGAVVYPEGPPPSYESVMQQQAAAVMQSSLEAPFVPPRYLAPTEGRNSIRYSELAPQYDTTRLYLVDNKSADIASLNYQNDHSNFLTTVVQNNDFTPTEASTQTINFDERSRWGGQLKTIMHTNMPNVNEYMFSNKFKARVMVSRKAPEGVTVDDKYDHKQDILKYEWFEFTLPEGNFSATMTIDLMNNAIIDNYLEIGRQNGVLESDIGVKFDTRNFRLGWDPETKLIMPGVYTYEAFHPDIVLLPGCGVDFTESRLSNLLGIRKRHPFQEGFQIMYDDLEGGNIPAILDVETYEKSKKENASATTTTTAVTTDARMVAETSAEAAVAVVVDTIKEQNDSVPRGDNYQSAKDMKASDETAVVVVPVVPGVVTETETKSPTIQPLKKDSKSRSYNVLEDEVNTAYRSWYLSYNYGDPEKGVRSWTLLTTSDVTCGAEQVYWSLPDMMQDPVTFRSTRQVSNYPVVGAELMPVFSKSFYNEQAVYSQQLRQTTSLTHVFNRFPENQILIRPPAPTITTVSENVPALTDHGTLPLRSSIRGVQRVTVTDARRRTCPYVYKALGIVAPRVLSSRTF

SEQ ID NO: 97 - protein, 587 aa, Ape adenovirus AH29; identical to SEQ ID NO: 27

SEQ ID NO: 98 - protein, 1193 aa, Ape adenovirus AH29
MALVQAHGSGSFHPEASDPGHQPPRRRARKSSQGAVPEPTRARRRRASASHAAGARAAPTARRAPSPPLLNMQEATEPPPPKRKNKGTVVAPKGHGTLQAIDITTNGPVEIKYHLNLPHALEKIMQVNLLTLPTNLTPQRLRTLDSSGLRALVLELRPSRAEVWTCLPRGLVSMTTIETEDGQADADNIVEREVQAPGLNFPLKFLVKGSQVQLIHEVHPVKRCEYCGRLYKHKHECSARRREFYFHHINSHSSNWWQEIQFFPIGSHPRTERLFLTYDVETYTWMGSFGKQLIPFMLVMKLSGDERLVNIAYDLAIKLKWDRWQQDPKTFYCITPEKMAVGQHFRQYRDQLQTALAVDLWSSFLNANPHLHEWALEHYALSDPTDLTFEELKKLPHVRGTPRFIELYIVGHNINGFDEIVLAAQVINNRAEVPQPFRITRNFMPRAGKILFNDVTFALPNPAYKKRVDFQLWEQGACDDIDFKHQFLKVMVRDTFALTHTSLRKAAQAYSLPVEKGCCPYKAVNQFYMLGSYRADKDGFPLEEYWKDREEYLLNRELWEKKNQPGYDIIQETLDYCALDVLVTAELVAKLQESYAHFIRDSVGLPHAHFNIFQRPTISSNSHAIFRQIVYRAEKPNRTNLGSGLLAPSHELYDYVRASIRGGRCYPTYIGILEEPLYVYDICGMYASALTHPMPWGTPLNPYERALAAREWQMALDDPTPISYFDKDLLPGIFTMDADPPDELMLDPLPPFCSRKGGRLCWTNEPLRGEVTTSVDLITLHNRGWRVRIVPDELTTIFPEWKCLAREYVQLNIAAKERADKEKNQTMRSIAKLLSNALYGSFATKLDNKKIVFSDQMDESLMKGISAGTVNIKSSSFLETDNLSAEVMPAFEREYLPQQLALLDSDPEDSEDEQRPAPFYTPPAGTPGHVAYTYKPITFLDVEEGDMCLHTVEKVDPLVDNDRYPSHVASFVLAWTRAFVSEWSEFLYEEDRGTPLEDRPIKSVYGDTDSLFVTQRGHELMETKGKKRIKKHGGKLVFDPDEPDLTWLVECETVCASCGADAYSPESIFLAPKLYALKCLYCPACQKTSKGKLRAKGHAAEALNYELMVNCYLADMQGADRQRFSTSRMSLKRTLASAQPGAHPFTVTETTLTRTLRPWKDRTLAALDAHRLIPYSRSRPNPRNEEVCWIEMP

SEQ ID NO: 99 - protein, 209 aa, Ape adenovirus AH29
MACGSGNGSSEQELRAIARDLGCGPYFLGTFDKRFPGFMAPDKLACAIVNTAGRETGGEHWLAFGWNPRSNTCYLFDPFGFSDERLKQIYQFEYEGLLRRSALATKDRCITLEKSTQTVQGPRSAACGLFCCMFLHAFVHWPDRPMDGNPTMKLLTGVPNSMLQSPQVQPTLRHNQEALYRFLNSHSSYFRSHRARIEKATAFDRMDMQ

SEQ ID NO: 100 - protein, 663 aa, Ape adenovirus AH29
MALSINDCARLTGQTVPTMNYFMPLRNIWNRVREFPRASTTASGITWMSRYIYGYHRLMLEDLAPGAPATERWPLYRQPPPHFLIGYQYLVRTCNDYIFDTRAYSRLKYTEIVRPGHQTVNWSVMANCSYTINTGAYHRFVDFDDFQATLTQVQQAILAERVVADLALVQPMRGFGLTRMHGRAGEEEVPVERLMQDYYKDLARCQDNAWGMADRLRIQQAGPKDLVLLATIRRLRTAYFNFITSSIVSPSRDDEEGEGRENPDRASSHPRPQETVLSLPCDCDWLDAFVERFSDPVDLQTIRSLRGVPTGQLIKCIISALSLPNGEPPSHHFREMRGGVFTLRPRENGRAVTETMRRRRGEVIERFIDRLPVRRRRRRAPPPPPPPPEEEEEMLVEEEIEEEEEEEIPGAFEREVRATIAELIRLLEEELTVSARNSQFFNFAVDFYEAMERLEALGDVSEMPLRRWIMYFFVTEHIATTLNYLFQRLCNYAVFTRHVELNLAQVVMRARDPEGAVVYSRVWNEAGMNAFSQLMGRISNDLAATVERAGRGDLQEEEIEQFMAEIAYQDNSGDVQEILRQAAVNDTEIDSVELSFRFKLTGPVAFTQRRQIQDINRRVVAHASLLRAQYQNLPARGADVPLPAMPPGPEPPLPPGARPRHRF

SEQ ID NO: 101 - protein, 250 aa, Ape adenovirus AH29
MEDINFSSLAPRHGTRPYMGTWSDIGTSQLNGGAFNWSSIWSGLKNFGSTIKTYGNKAWNSSTGQALRNKLKEQNFQQKVVDGIASGINGVVDLANQAVQKQINSRLDPPPAAHGEMEVEEELPPLEKRGDKRPRPDMEETLVTRGDEPPPYEEAIKLGMPTTRPIAPMATGVMKPSQSHRPATLDLPPAPAAAAPAPKPVATPKPTAVQPVAVARPRPGGTPRPNANWQSTLNSIVGLGVQSVKRRRCY

SEQ ID NO: 102 - protein, 192 aa, Ape adenovirus AH29
MSILISPSNNTGWGLRTPTRMYGGARKRSTQHPVRVRGHFRAPWGALKGRARTRTTVDDVIDQVVADARNYTPAAPASTVDAVIDSVVADARDYARRKSRRRRIARRHRATPAMRAARALLRRAKRVGRRAMLRAARRAASGASAGRSRRRAATAAAAAIANMAQPRRGNVYWVRDATTGQRVPVRTRPPRT

SEQ ID NO: 103 - protein, 227 aa, Ape adenovirus AH29; identical to SEQ ID NO: 67

SEQ ID NO: 104 - protein, 75 aa, Ape adenovirus AH29
MALTCRLRVPITGYRGRNSRRRRMLGSGMRRHRRRRAISKRLGGGFLTALIPIIAAAIGAVPGIASVAVQASQRH

SEQ ID NO: 105 - protein, 350 aa, Ape adenovirus AH29
MSKRKYKEEMLQVIAPEIYGPPVKDEKKPRKIKRVKKDKKEEDDDDGLVEFVREFAPRRRVQWRGRRVQPVLRPGTTVVFTPGERSSTTFKRSYDEVYGDDDILEQAADRLGEFAYGKRSRSNPKEEAVSIPLDHGNPTPSLKPVTLQQVLPVPPRRGVKREGEDLYPTMQLMVPKRQKLEDVLEKMKVDPDIQPEVKVRPIKQVAPGLGVQTVDIKIPTESMEVQTEPAKPAATSIEVQTDPWMPAPIATDASTVRRPRRKYGPASLLMPNYALHPSIIPTPGYRGTRYYRSRSTTSRRRKTPASRSRRRRRRTTSKLTPAALVRRVYRDGRAEPLMLPRARYHPSITT

SEQ ID NO: 106 - DNA, 37704 bp, Ape adenovirus AH6
catcatcaataatataccttattttggattgaagccaatatgataatgaggtgggcggagcggggcggggcggggaggagcggcggcgcggggcgggccgggaggtgtggcggaagttgagtttgtaagtgtggcggatgtgacttgctagcgccggatgtggtaaaagtgacgtttttggagtgcgacaacgcccacgggaagtgacatttttcccgcggtttttaccggatgtcgtagtgaatttgggcgttaccaagtaagatttggccattttcgcgggaaaactgaaatggggaagtgaaatctgattaatttcgcgttagtcataccgcgtaatatttgccgagggccgagggactttgaccgattacgtggaggaatcgcccaggtgttttttgaggtgaatttccgcgttccgggtcaaagtctccgttttattattatagtcagctgacgcggagtgtatttatacccgctgatctcgtcaagaggccactcttgagtgccagcgagtagagttttctcctctgccgctccgctctgacaccgggggaaaaatgagacatttcacctacgatggcggtgtgctcaccggccagctggctgcctcggtcctggacgccctgatcgaggaggtattggccgacaattatcctcctccagctcattttgagccacctactcttcacgaactgtatgatttggacgtggtggcacctagcgacccgaacgagcaggcggtttccagtttttttcctgactctatgctgttggccagccaggagggggtcgagctcgagacccctcctccaatcgccgtttctcctgagcctccgaccctgaccaggcagcccgatcgccgtgttggacctgcgactatgccccatctgctgcccgaggtgatcgatctcacctgtaacgagtctggttttccacccagcgaggatgaggacgaagagggtgagcagtttgtgttagattctgtggaggaacccgggcgcggttgcagatcttgtcaataccatcggaaaaatacaggagacccccaaattatgtgttccctgtgttatatgaagacgacctgtatgtttatttacagtaagtttgtgattggtgggtcggtgggctgtagtgtgggtaggtggtctgtggttttttttttttttaatatcagcttgggctaaaaaaactgctatggtaatttttttaaggtccggtgtctgaacctgagcaggaagctgaaccggagcctgagagtcgccccaggagaaggcctgcaattctaactagaccgagtgcacctgtagcgagggacctcagcagtgcagagaccaccgattccggtccttcctcatcccctccagagattcatcccgtggtgcctttgtgtcccctcaagcccgttgccgtgagagttagtgggcggagggccgccgtggagagcattgaggacttgcttaatgagacacaggaacctttggacttgagctgtaaacgccctaggcaataaacctgcttacctggactgaatgagttgacgcctatgtttgcttttgaatgacttaatgtgtatataataaagagtgagataatgtttaattgcatggtgtgtttgattggggcggggtttgttgggtatataagcttccctgggctaaacttggttacacttgacctcatggaggcctgggagtgtttagagagctttgccgaagtgcgtgctttgctggaagagagctctaataatacctctgggtggtggaggtatttttggggctctccccaggctaagttagtttgtagaatcaaggaggattacaagtgggaatttgaacagcttttgaaatcctgtggtgagctcttggattctttgaatctgggccaccaggctcttttccaggacaagatcatcaggactttggatttttccacaccggggcgcgttgctgccggggttgcttttctagcttttttgaaggataaatggagcgaagagacccacttgagttcgggatacgtcctggattttctggccatacaactgtggagggcatggatcaggcacaagaacagaatgcaactgttgtcttccgtccgtccgttgctgattcagccggaggagcagcagaccgggccggaggaccgggctcgtccggaaccagaggagagggcacccgcggcggcgccggagaggagcgcgtggaacctgggagccggcctgaacggccatccacatcgggagtgaatgttggacaggtggcggatctctttccagaactgcgacgaatcttgactattagggaggatggacaatttgttaagggccttaagagggagcggggggcttctgaacataacgaggaggccagtaatttagcttttagtctgatgaccagacaccgtcccgagtgcattacttttcagcagattaaagataattgtgccaatgagttagatctgctgggtcagaagtacagcatagagcagttgaccacttactggttgcagccgggtgatgatctggaggaagctattagggtgtatgccaaggtggctctgaggcccgattgcaagtacaagctcaaggggctggtgaatatcaggaattgttgctacatttctgggaacggggcggaggtggagatagagaccgatgacagggtggcctttaggtgcagcatgatgaatatgtggcctggggtgctgggcatggacggggtggtgattatgaatgtgaggttcacggggcccaattttaatggcacggtgttcctgggcaacaccaacctggtgctgcacggggtgagcttctatggctttaacaacacctgtgtggaggcctggaccgatgtgaaggtccgtggctgtgccttctacggatgttggaaggcggtagtgtgtcgccccaagagcaggagttccattaaaaaatgcttgtttgagaggtgcaccctgggggtgctggcggagggcaactgtcgggtgcgccacaatgtggcctccgaatgcggttgcttcatgctagtgaagagcgtggcggtcatcaagcataacatggtgtgcggcaacagcgaggacaaggcctcgcagatgctgacctgctcggatggcaactgccacttactcaagaccatccatataaccagccacagccgcaaggcctggcccgtgttcgagcacaacgtgttgacccgctgctccttgcatctgggcaacaggaggggtgtgttcctgccctatcaatgcaacttgagccacaccaaggtcttgctagagcccgaaagcatgtccaaggtgaacctgaacggggtgtttgacatgaccctgaagatatggaaggtgctgaggtacgacgagaccaggtcccggtgcaggccctgcgagtgcgggggcaagcatatgaggaaccagcctgtgatgctggatgtgaccgaggagctgaggcctgaccacttggttctggcctgcaccagggccgagtttggttctagcgatgaagacacagactgaggtgggtgagtgggcgtggtctgggggtgggaagcaatatataagttgggggtcttagggtctctgtgtctgttttgcagagggaccgccggcgccatgagcgggagcagtagcagcaacgctttggatggcagcatcgtgagcccttatttgacgacgcgcatgccccactgggccggggtgcgtcagaatgtgatgggctccagcatcgacggacgacccgtgctgcccgcaaattccgccacgctgacctacgcgaccgtcgcggggaccccgttggacgccaccgccgccgccgccgccaccgccgccgcctcggccgtgcgcagcctggccacggactttgcattcttgggacccttggccaccggggcggccgcccgtgccgccgttcgcgatgacaagctgaccgccctgctggcgcagttggatgcgcttacccgggaactgggtgacctttcgcagcaggtcgtggccctgcgccagcaggtctccgccctgcaggctagcgggaatgcttctcctgcaaatgccgtttaagataaataaaaccagactctgtttggattaaagaaaagtagcaagtgcattgctctctttatttcataattttccgcgcgcgataggcccgagtccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttaagcagcaggccgatggccagggggaggcccttggtgtaagtgtttacaaaacggttgagttgggaagggtgcatgcggggtgagatgatgtgcatcttagattgtatttttagattggcgatgtttcctcccagatcccttctgggattcatgttgtggaggaccaccagcacagtatatccggtgcacttgggaaatttgtcatgcagcttagagggaaatgcgtggaagaacttggagacgcccttgtggcctcccagattctccatgcattcgtccatgatgatggcaatgggcccgcgggaggcggcctgggcaaagatgtttctggggtcactgacatcgtagttgtgttccagggtgagatcgtcataggccatttttataaagcgcgggcggagggtgcccgactgggggatgatggttccctcgggccccggggcgtagttgccttcgcagatctgcatttcccaggccttaatctctgaggggggaatcatatccacttgcggggcgatgaaaaaaacggtttccggagccggggagattaactgggatgagagcaggtttctcagcagctgtgactttccacagccggtgggcccataaataacacctataaccggctgcagctggtagttgagcgagctgcagctgccgtcgtcccggaggaggggggccacctcattgagcatgtcccggacgcgcttgttctcctcgaccaggtccgccagaaggcgctcgccgcccagggacagcagctcttgcaaggaagcaaagtttttcagcggtttgaggccgtccgccgtgggcatgtttttcagggtctggccgagcagctccaggcggtcccagagctcggtgacgtgctctacggcatctctatccagcatatctcctcgtttcgcgggttggggcggctttcgctgtagggcaccaggcgatggtcgtccagcgcggccagagtcatgtccttccatgggcgcagggtcctcgtcagggtggtctgggtcacggtgaaggggtgcgccccgggctgggcgctggccagggtgcgcttgagactggtcctgctggtgctgaagcgctgccggtcttcgccctgcgcgtcggccaggtagcatttgaccatggtgtcgtagtccagcccctccgcggcgtgtcccttggcgcgcagcttgcccttggaggtggcgccgcacgcggggcactgcaggctcttgagcgcgtagagcttgggggcgaggaagaccgattcgggggagtaggcgtccgcgccgcaggccccgcacacggtctcgcactccaccagccaggtgagctcggggcgctcggggtcaaaaaccaggtttcccccatgctttttgatgcgtttcttacctcgggtctccatgaggcggtgtccccgttcggtgacgaagaggctgtccgtgtctccgtagaccgacttgaggggtctgtcctccaggggggtccctcggtcctcttcgtagagaaactcggaccactctgagacaaaggcccgcgtccaggccaggacgaaggaggccaggtgggaggggtaccggtcgttgtccactagggggtccaccttctccaaggtgtgaagacacatgtcgccctcctcggcgtccaggaaggtgattggcttgtaggtgtaggccacgtgacccggggttccggaagggggggtataaaagggggtgggggcgcgctcgtcctcactctcttccgcatcgctgtctgcgagggccagctgctggggtgagtattccctctcgaaggcgggcatgacctcagcgctgaggctgtcagtttctaaaaacgaggaggatttgatgttcacctgtcccgagctgatgcctttgagggtgcccgcgtccatctggtcagaaaacacgatctttttattgtccagcttggtggcgaacgacccgtagagggcgttggagagcagcttggcgatggagcgcagggtctgattcttgtcccggtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgacgaggtccacgctggtggcgacctcgccgcgcaggcgctcgttggtccagcagaggcgcccgcccttgcgcgagcagaaggggggcagggggtcgagttgggtttcgtccggggggtccgcgtccaccgtgaagaccccggggcgcaggcgcgcgtcgaagtagtcgatcttgcatccttgcaagtccagcgcccgctgccagtcgcgggcggcgagcgcgcgctcgtaggggttgagcggcgggccccagggcatggggtgggtgagcgcggaggcgtacatgccgcagatgtcatagacgtagaggggctcccggaggatgcccaggtaggtggggtagcagcggccgccgcggatgctggcgcgcacgtagtcgtagagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgtaggccgacggcgtcgcgcacgaaggaggcgtaggactcgcgcagcttgtgcaccagctcggcggtgacctgcacgtcgagcgcgcagtagtcgagggtctcgcggatgatgtcatacttagcctgccccttctttttccacagctcgcggttgaggacgaactcttcgcggtctttccagtactcttggattgggaaaccgtccggctccgaacggtaagagcccagcatgtagaactggttgacggcctggtaggcgcagcagcccttctccacgggcagggcgtaggcctgcgcggccttgcggagcgaggtgtgggtcagggcgaaggtgtccctgaccatgaccttgaggtactggtgtttgaagtcggagtcgtcgcagccgccccgctcccagagcgtgaagtcggtgcgctttttggagcgggggttgggcagcgcgaaggtgacatcgttgtagaggatcttgcccgcgcgaggcatgaagttgcgggtgatgcggaagggccccggcacttccgagcggttgttgatgacctgggcggcgagcacgatctcgtcgaagccgttgatgttgtggcccacgatgtagagttccaggaagcggggccggcccttgacgctgggcagcttttttagctcttcgtaggtgagctcctcgggcgaggcgaggccgtgctcggccagggcccagtccgccaggtgcgggttgtccgcgaggaaggaccgccagaggtcgcgggccaggagggtctgcaggcggtccctgaaggtcctgaactggcggcctacggccatcttttcgggggtgacgcagtagaaggtgagggggtcttgctgccaggggtcccagtcgagctccagggcgaggtcgcgcgcggcggcgaccaggcgctcgtcgcccccgaatttcatgaccagcatgaagggcacgagctgctttccgaaggcgcccatccaagtgtaggtctctacatcgtaggtgacaaagagacgttccgtgcgaggatgcgagccgatcgggaagaactggatctcccgccaccagttggaggagtggctgttgatgtggtgaaagtagaagtcccgtcggcgggccgagcactcgtgctggcttttgtaaaagcgagcgcagtactggcagcgctgcacgggctgtacctcttgcacgagatgcacctgccgaccgcggacgaggaagctgagtgggaatctgagccccccgcatggctcgcggcctggctggtgctcttctactttggatgcgtggccgtcaccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggtttacctcgcagagacgggccagggcgcggggcaggtccaggtggtacttgaattcgagaggcgtgttggtggcggcgtcgatggcttgcaggaggccgcagccccggggcgcgacgacggtgccccgcggggcggtgaagctcccgccgccgctcctgctgtcgccgccggtggcggggcttagaagcggtgccgcggtcgggcccccggaggtagggggggctccggtcccgcgggcaggggcggcagcggcacgtcggcgccgcgcgcgggcaggagctggtgctgcgcccggaggttgctggcgaaggcgacgacgcggcggttgatctcctggatctggcgcctctgcgtgaagacgacgggtccggtgagcttgaacctgaaagagagttcgacagaatcaatctcggtgtcattgaccgcgacctggcgcaggatctcctgcacgtcgcccgagttgtcttggtaggcgatctcggccatgaactgttcgatctcttcctcctggaggtctccgcgtccggcgcgctccacggtggccgccaggtcgttggagatgcgcgccatgagctgcgagaaggcgttgagtccgccctcgttccagactcggctgtagaccacgccgccctggtcgtcgcgggcgcgcatgaccacctgcgcgaggttgagttccacgtggcgcgcaaagacggcgtagttgcgcaggcgctggaagaggtagttgagggtggtggcggtgtgctcggccacgaagaagtacatgacccagcggcgcaacgtggattcgttgatgtcccccaaggcctccagtcgctccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgccagcatcaccacctcttcctcttcttcctcctctggcacttccatgatggcttcctcctcttcggggggtggcggcggcgggggagggggcgctcggcgccggcggcggcgcaccgggaggcggtccacgaagcgctcgatcatctccccgcggcggcgacgcatggtctcggtgacggcgcggccgttctctcgggggcgcagctggaagacgccgccggtcatctggtgctggggcgggtggccgtggggcagcgagaccgcgctgacgatgcatctcaacaactgttgcgtaggtacgccgccgagggacctgagggagtccagatccaccggatccgaaaacctttcgaggaaggcatctaaccagtcgcagtcgcaaggtaggctgagcaccgtggcgggcggcggggggtggggggagtgtctggcggaggtgctgctgatgatgtaattgaagtaggcggtcttgacacggcggatggtcgacaggagcaccatatctttgggcccggcctgctggatgcggaggcggtcggccatgccccaggcttcgttctggcatctgcgcaggtctttgtagtagtcttgcatgagcctttccaccggcacctcttctccttcttcttctgacatctctgctgcatctgcggccctggggcgacggcgcgcgcccctgccccccatgcgcgtcaccccgaaccccctgagcggctggagcagggccaggtcggcgacgacgcgctcggccaggatggcctgctggacctgcgtgagggtggtttggaagtcatccaagtccacgaagcggtggtaggcgcccgtgttgatggtgtaggtgcagttggccatgacggaccagttgacggtctggtggcccggttgcgtcatctcggtgtacctgaggcgcgagtaggcgcgcgagtcgaagatgtagtcgttgcaagtccgcaccaggtactggtagcccaccaggaaatgcggcggcggctggcggtagaggggccagcggagggtggcgggggctccgggggccaggtcttccagcatgaggcggtggtattcgtagatgtacctggacatccaggtgatgcccgcggcggtggtggaggcgcgcgggaagtcgcgcacccggttccagatgttgcgcagcggcagaaagtgctccatggtaggcgtgctctggccggtcaggcgcgcgcagtcgttgatactctagaccggggaaaacgaaagccggtcagcgggcactcttccgtggtctggtggataaattcgcaagggtatcatggcggagggcctcggttcgagccccgggcccgggccggacggtccgccatgatccacgcggttaccgcccgcgtgtcgaacccaggtggcgacgtcagacaacggtggagtgttccttttggggtttttccaaatttttttggccgggcgccgacgccgccgcgtaagagactagagtgcaaaagcgaaagcagtaagtggctcgctccctgtagcccggaggatccttgctaagggttgcgttgcggcgaaccccggttcgagtctggctctcgcgggccgctcgggtcggccggaaccgcggctaaggcgggattggcctccccctcattaaagaccccgcttgcggattcctccggacacaggggacgagcccctttttacttttgcttttctcagatgcatccggtgctgcggcagatgcgccccccgccccagcagcagcagcagcaacatcagcaagagcggcaccagcagcagcgggagtcatgcagggccccctcgcccacgctcggcggtccggcgacctcggcgtccgcggccgtgtctggagccggcggcggggggctggcggacgacccggaggagcccccgcggcgcagggccagacagtacctggacctggaggagggcgagggcctggcgcgactgggggcgccgtcccccgagcgccacccgcgggtgcagctgaagcgcgactcgcgcgaggcgtacgtgcctcggcagaacctgttcagagaccgcgcgggcgaggagcccgaggagatgcgggaccgcaggttcgccgcggggcgggagctgcggcaggggctgaaccgggagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaaaagcttcaacaaccacgtgcgcacgctggtggcgcgcgaggaggtgaccatcggcctgatgcacctgtgggactttgtgagcgcgctggagcagaaccccaacagcaagcctctgacggcgcagctgttcctgatagtgcagcacagcagggacaacgaggcgttcagggacgcgctgctgaacatcaccgagcccgagggtcggtggctcctggacctgattaacatcttgcagagcatagtggtgcaggagcgcagcctgagcctggccgacaaggtggcggccatcaattactcgatgctcagtctgggcaagttttacgcgcgcaaaatctaccagacgccgtacgtgcccatagacaaggaggtgaagatcgacggcttctacatgcgcatggcgctgaaggtgctgaccctgagcgacgacctgggcgtgtaccgcaacgagcgcatccacaaggccgtgagcgtgagccggcggcgcgagctgagcgaccgcgagctgatgcacagcctgcagcgggcgctggcgggggccggcagcggcgacagggaggccgagtcctacttcgaggcgggggcggacctgcgctgggtgcccagccggagggccctggaggccgcgggggcccgccgcgaggactatgcagacgaggaggaggaggatgacgaggagtacgagctagaggagggcgagtacctggactaaaccgcaggtggtgtttttggtagatgcaagacccgaacgtggtggacccggcgctgcgggcggctctgcagagccagccgtccggccttaactctacagacgactggcgacaggtcatggaccgcatcatgtcgctgacggcgcgcaatccggacgcgttccggcagcagccgcaggccaacaggctctccgccatcttggaggcggtggtgcctgcgcgcgcgaaccccacgcacgagaaggtgctggccatagtgaacgcgctggctgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgggagcgcgcggagcggcagggaaacctgggctccatggtggcgctgaacgccttcctgagcacgcagccggccaacgtgccgcgggggcaggaggactacaccaactttgtgagcgcgctgcggctgatggtgaccgagaccccccagagcgaggtgtaccagtcggggccggactacttcttccagaccagcagacagggcctgcagacggtgaacctgagccaggctttcaagaacctgcgggggctgtggggggtgaaggcgcccaccggggaccgggcgacggtgtccagcctgctgacgcccaactcgcgcctgctgctgctgctgatcgcgccgttcacggacagcggcagcgtgtcccgggagacctacctcgggcacctgctgacgctgtaccgcgaggccatcgggcagacccaggtggacgagcacaccttccaggagatcaccagcgtgagccgcgcgctggggcaggaggacacgggcagcctggaggcgaccctgaactacctgctgaccaaccggcggcagaagatcccctcgctgcatagtttgaccaccgaggaggagcgcatcctgcgctacgtgcagcagagcgtgagcctgaacctgatgcgcgacggggtgacgcccagcgtggcgctggacatgaccgcgcgcaacatggaaccgggcatgtacgccgcgcatcggccttacatcaaccgcctgatggactacttgcatcgcgcggcggccgtgaaccccgagtacttcaccaacgccatcctgaacccgcactggctcccgccgcccgggttctacagcgggggcttcgaggtccccgaggccaacgacggcttcctgtgggacgacatggacgacagcgtgttctccccgcggccgcaggcgctggcggaggcgtcgctgctccgcctccccaagaaagaagagagccgccggcccagcagcgcggcggcctctctgtccgagctgggggcggcggccgcgcggcccgggtccctggggggcagcccctttcccagcctggtggggtctctgcagagcgggcgcaccacccggccccggctgctgggcgaggacgagtacctgaacaactccctgatgcagccggtgcgggagaaaaacctgccccccgccttccccaacaacgggatagagagcctggtagacaagatgagcagatggaagacctatgcgcaggagcacagggactcgcccgtgctccgcccgcccacgcggcgccagcgccacgaccggcagcgggggctggtgtgggatgacgaggactccgcggacgatagcagcgtgctggacctgggggggagcggcggcaacccgttcgcgcacctgcgcccccgcctggggaggatgtttcaataaaaaatcaagcatgatgcaaggtttttttaagcggataaataaaaaactcaccaaggccatggcgaccgagcgttgttggtttcttgttgtgttcccttagtatgcggcgcgcggcgatgtaccacgagggacctcctccctcttatgagagcgtggtgggcgcggcggcggcctctccctttgcgtcgcagctggagccgccgtacgtgcctccgcggtacctgcggcctacggggggaagaaacagcatccgttactcggagctggcgcccctgtacgacaccacccgggtgtacctggtggacaacaagtcggcggacgtggcctccctgaactaccagaacgaccacagcaattttttgaccacggtcatccagaacaatgactacaccccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggacgaccgggtggagctgaagtacgagtgggtagagttcgagctgcccgagggcaactactcggagaccatgaccatagacctgatgaacaacgcgatcgtggagcactatctgaaagtgggcaggcaaaacggggtcctggagagcgacatcggggtcaagtttgacaccaggaacttccgcctggggctggacccggtcaccgggctggtcatgcccggggtctacaccaacgaggccttccaccccgacatcatcctgctgcccggctgcggggtggacttcacttacagccgcctgagcaacctgctgggcatccgcaagcggcagcccttccaggagggctttaggatcacctacgaggacctggaggggggcaacatccccgcgctcctggatgtggaggcctaccaggatagcttgaaggaagaagaggcgggagagggcagcggcggcggcgccgctcaggaggagggcggggcctcctctgagacctctgcggacgcagccgccgccgctaccgcggccgaggcagaggcggccgaccccgcgatggtggtagaggaagagaaagatatgaatgacgaggcggtgcgcggcgacacctttgccacccggggggaggagaagaaagcggaggccgaggccgcggcagaggaggcggcagcagcggcggcggcagtagaggcggcggccgaggcggagaagccccccaaggagcccgtgattaagcccctgaccgaagatagcaagaagcgcagttacaacgtgctcaaggacagcaccaacaccgagtaccgcagctggtacctggcctacaactacggcgacccggcgacgggggtgcgctcctggaccctgctgtgtacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgtaactgacgccagacgccgcacctgtccctacgtttacaaggccctgggcatagtctcgccgcgcgtcctttccagccgcactttttaagcatgtccatcctcatctcgcccagcaataacaccggctggggcctgctgcgcgcgcccagcaagatgttcggaggggcgaggaagcgctccgaccagcaccccgtgcgcgtgcgcgggcactaccgcgccccctggggcgcgcacaaacgcgggcgcaccggcaccgcggggcgcaccaccgtggacgaagccatcgactcggtggtggagcaggcgcgcaactacacgcccgcggtctccaccgtggacgcggctatcgagagcgtggtgcgaggcgcgcggcggtacgccaaggcgaagagccgccggaggcgcgtggcccgccgccaccgccgccgacccggaagcgccgccaagcgcgccgccgccgccttgcttcgtcgggccagacgcacgggccgccgcgccgccatgagggccgcgcgccgcctggccgccggcatcaccaccgtggccccccgcgccagaagacgcgcggccgctgccgccgccgcggccatcagcgacctggccaccaggcgccggggcaacgtgtactgggtgcgcgactcggtgagcggcacgcgcgtgcccgtgcgcttccgccccccgcggacttgagaggagaggacaggaaaaaagcatcaacaacaacaccactgagtctcctgctgttgtgtgtatcccagcggcgcgcgcgcacacggcgacatgtccaagcgcaaaatcaaagaagagatgctccaggtcgtcgcgccggagatctatgggcccccgaagaaggaagagcaggatttcaagccccgcaagataaagcgggtcaaaaagaaaaagaaagatgacgatgatggcgaggtggagtttctgcgcgccacggcgcccaggcgcccgctgcagtggaagggtcggcgcgtaaagcgcgttctgcgtcccggcaccgcggtggtcttcacgcccggcgagcgctccacccgcactttcaagcgcgtctatgacgaggtgtacggcgacgaagacctgctggagcaggccaacgatcgctccggagagtttgcttacgggaagcggcaccgggcgatggagaaggacgaggtgctggcgctgccgctggaccggggcaaccccacccccagcctgaagcccgtgaccctgcagcaggtgctgccgagcagcgcgccctccgagatgaagcggggcctgaagcgcgagggcggcgacctggcgcccaccgtgcagctgatggtgcccaagcggcagaggctggaggacgtgctggagaaaatgaaagtagaccccggcctgcagccggacatcagggtccgccccatcaagcaggtggcgccgggcctcggcgtgcagaccgtggacgtggtcatccccaccggcgcctcctcttccagcgccgccgccgccactagcaccgcggacatggagacgcagactagctcctccctcgtcgcccccgcggccgccgccgccgccacctcctcggcggaggtacagacggacccctggatgccaccgccggcggccgccccctcgcgcgcacgccgcgggcgcaggaagtacggtgccgccagcgcgctcatgcccgagtacgccttgcatccttccatcgcgcccacccccggctaccgaggctacagttaccgcccgcgaagagccaagggctccacccgccgcagccgccgcgccgccacctctacccgccgccgcagtcgccgccgccgccggcagcccgcgctggctccgatctccgtgaggagagtggcgcgcaacggggacaccttggtgctgcccagggcgcgctaccaccccagcatcgtttaaaagcctgttgtggttcttgcagatatggccctcacttgccgcctccgtttcccggtgccgggataccgaggaagatcgcgccgcaggaggggtatggccggacgcggcctgagcggaggcagccgccgtgcgcaccggcggcgacgcgccaccagccgacgcatgcgcggcggggtgctgcctctgctgatccccctgatcgccgcggcgatcggcgccgtgcccgggatcgcctccgtggccttgcaggcgtcccagaggcgttgacacagacttcttgcaagcttgcaaaaatatggaaaaaatccccccaataaaaaagtctagactctcacgctcgcttggtcctgtgactattttgtagaaaaaagatggaagacatcaactttgcgtcgctggccccgcgtcacggctcgcgcccgttcctgggacactggaacgatatcggcaccagcaacatgagcggtggcgccttcagttggggctctctgtggagcggcattaaaaatatcggttctgccgttaagaattacggcaccaaggcctggaacagcagcacgggccagatgttgagagacaagttgaaagagcagaacttccagcagaaggtggtggagggcctggcctccggcatcaacggggtggtggacctggccaatcaggccgtgcaaaataagatcaacagcagactggacccccggccgccggtggaggagctgccgccggcgctggagacggtgtcccccgatgggcggggcgaaaagcgcccgcggcccgacagggaagagaccactctggtcacgcacaccgatgagccgcccccctacgaggaagccctgaagcaaggcttgcccaccactcggcccatcgcgcccatggccaccggggtggtgggccgccacacccccgccacgctggacctgcctcctcctcctgtttcttcttcggccgccgatgcgcagcagcagaaggcggcgctgcccggtccgcccgcggccgccccccgtcccaccgccagtcgagcgcccctgcgtcgcgcggccagcggcccccgcggggtcgcgaggcacagcagcggcaactggcagaacacgctgaacagcatcgtgggtctgggggtgcagtccgtgaagcgccgccgatgctactgaatagcttagctaacggtgttgtatgtgtgtatgcgtcctatgtcaccgccagaggagctgctgagtcgccgccgttcgcgcgcccaccgccactaccaccgccggtaccactccagcgcccctcaagatggcgaccccatcgatgatgccgcagtggtcgtacatgcacatctcgggccaggacgcctcggagtacctgagccccgggctggtgcagttcgcccgcgccaccgacagctacttcagcctgagtaacaagtttaggaaccccacggtggcgcccacgcacgatgtgaccaccgaccggtcccagcgcctgacgctgcggttcatccccgtggaccgcgaggacaccgcgtactcttacaaggcgcggttcaccctggccgtgggcgacaaccgcgtgctggacatggcctccacctactttgacatccgcggcgtgctggacaggggccccaccttcaagccctactccggcaccgcctacaactccctggcccccaagggcgcccccaacccctgtgagtgggatgaagccgttactgctgttgacattaacctggatgagctcggcgaagatgaagacgacgccgaaggggaagcagaacagcaaaaaactcatgtatttggtcaagcgccctactcaggacaaaacattacgaaggagggcatacaaattggggtagataccaccagccaagcccaaacacctttatacgctgacaaaacattccaacccgaacctcaggttggagaatcccaatggaatgagacagaaatcaattatggagcgggacgagtgctaaaaaagaccaccctcatgaaaccatgctatgggtcatatgcaagacctactaatgaaaacggcggtcagggcatactgctggagaaagagggtggtaaaccagaaagtcaagttgaaatgcaatttttttctactactcaggccgccgcggctggtaattcagataatcttactccaaaagttgttttgtatagcgaggatgttcacctggaaacgccagatacacacatttcatatatgcccactagcaacgaagccaattcaagagaactgttgggacaacaagctatgcccaacagacccaactacattgccttcagagacaactttattggccttatgtattacaacagcactggcaacatgggagtgctggcaggtcaggcctcacagttgaatgcagtggtggacttgcaagacagaaacacagaactgtcctaccagctcttgcttgattccatgggagacagaaccagatacttttccatgtggaatcaggcggtggacagttatgatccagatgttagaattattgaaaatcatggaactgaagatgagctgcccaactattgtttccccctgggcggcataattaacaccgaaactttaactaaagtgaaacctaagactggacaagacgctcagtgggaaaaagatactgagttttcagagaaaaatgaaataagggtgggaaacaacttcgccatggagattaacctcaatgccaacctgtggaggaatttcctgtactccaacgtggccctgtacctgccagacaaacttaagtacactccagccaacgtgcagatttccagcaactccaactcctacgactacatgaacaagcgagtggtggccccggggctggtggactgctacatcaacctgggcgcgcgctggtccctggactacatggacaacgtcaaccccttcaaccaccaccgcaacgcgggcctgcgctaccgctccatgcttctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggtaacgacctcagggtcgacggggccagcatcaagttcgagagcatctgcctctacgccaccttcttccccatggcccacaacacggcctccacgctcgaggccatgctcaggaacgacaccaacgaccagtccttcaacgactacctctccgccgccaacatgctctaccccatccccgccaacgccaccaacgttcccatctccatcccctcgcgcaactgggcggccttccgcggctgggccttcacccgcctcaagaccaaggagaccccctccctgggctcgggtttcgacccctactacacctactcgggctccataccctacctggacggaaccttctacctcaaccacactttcaagaaggtctcggtcaccttcgactcctcggtcagctggccgggcaacgatcgcctgctcacccccaacgagttcgagatcaagcgctcggtcgacggggagggctacaacgtggcccagtgcaacatgaccaaggactggttcctcatccaaatgctggccaactacaacatcggctatcagggcttctacatcccagagagctacaaggacaggatgtactccttctttaggaacttccagcccatgagccggcaggtggtggacgaaaccaagtacaaggactaccagcaggtgggcatcatccaccagcacaacaactcgggcttcgtgggctacctcgcccccaccatgcgcgagggacaggcctaccccgccaacttcccctacccgctcattggcaagaccgcggtcgacagcgtcacccagaaaaagttcctctgcgaccgcaccctctggcgcatccccttctccagcaacttcatgtccatgggtgcgctcacggacctgggccagaacctgctctatgccaactccgcccacgcgctcgacatgaccttcgaggtcgaccccatggacgagcccacccttctctatgttctgttcgaagtctttgacgtggtccgggtccaccagccgcaccgcggcgtcatcgagaccgtgtacctgcgcacgcccttctcggccggcaacgccaccacctaaagaagcaagccgccaccgccaccacctgcatgtcgtcgggttccaccgagcaggagctcaaggccatcgtcagagacctgggatgcgggccctattttttgggcaccttcgacaaacgcttcccgggcttcgtcgccccgcacaagctggcctgcgccatcgtcaacacggccggccgcgagaccgggggcgtgcactggctggccttcgcctggaacccgcgctccaaaacatgctacctctttgaccccttcggattctcggaccagcggctcaagcagatctaccagttcgagtacgagggcctgctgcgccgcagcgccatcgcctcctcgcccgaccgctgcgtcaccctcgagaagtccacccagaccgtgcaggggcccgactcggccgcctgcggtctcttctgctgcatgttcctgcatgcctttgtgcactggccccagagtcccatggaccgcaaccccaccatgaacttgctgacggggatccccaactccatgctccagagcccccaggtcgcgcccaccctgcgccgcaaccaggagcggctctacagcttcctggaacgccactcgccctacttccgccgccacagcgcgcagatcaggggggccacctctttctgccgcatgcaagagatgcaagggaaaatgcaatgatgtacacagacactttttcttttctcaataaatggcaactttatttatacatgctctctctcgggtattcatttccccaccacccaccacccgccgccgtaaccatctgctgctggctttttaaaaatcgaaagggttctgccgggaatcgccgtgcgccacgggcagggacacgttgcggaactggtagcgggtgccccacttgaactcgggcaccaccatgcggggcaagtcggggaagttgtcggcccacaggccgcgggtcagcaccagcgcgttcatcaggtcgggcgccgagatcttgaagtcgcagttggggccgccgccctgcgcgcgcgagttgcggtacaccgggttgcaacactggaacaccagcagcgccggataattcacactggccagcacgctccggtcggagatcagctcggcgtccaggtcctccgcgttgctcagcgcgaacggggtcagcttgggcacctgccgccccaggaagggagcgtgccccggcttcgagttgcagtcgcagcgcagcgggatcagcaggtgcccgcggccggactcggcgttggggtacagcgcgcgcatgaaggcctccatctggcggaaggccatctgggccttggcgccctccgagaagaacatgccgcaggacttgcccgagaactggttcgcggggcagctagcgtcgtgcaggcagcagcgcgcgtcggtgttggcgatctgcaccacgttgcgcccccaccggttcttcacgattttggccttggaagcctgctccttcagcgcgcgctgcccgttctcgctggtcacatccatctcgatcacgtgctccttgttcaccatgctgctgccgtgcagacacttcagctcgccctccacctcggtgcagcggtgctgccatagcgcgcagcccgtgggctcgaaatgcttgtaggtcacctccgcgtaggactgcaggtaggcctgcaggaagcgccccatcatggtcacgaaggtcttgttgctgctgaaggtcagctgcagcccgcggtgctcctcgttcagccaggccttgcacacggccgccagcgcctccacctggtcgggcagcatcttgaagttcagcttcagctcattctccacatggtacttgtccatcagcgcgcgcgcagcctccatgcccttctcccaggccgacaccagcggcaggctcaaggggttcaccaccgtcgcagccgccgctgcgctttcgctttccgctccgctgttctcttcttcctcctcctcttcttcctcgccgcccgcgcgcagcccccgcaccacggggtcgtcttcctgcaggcgccgcaccgagcgcttgccgctcctgccctgcttgatacgcacgggcgggttgctgaagcctaccatcaccagcgcggcctcttcttgctcgtcctcgctgtccactatgacctcgggggagggcgacctcagaaccgtggcgcgctgcctcttctttttcctgggggcgtttgccagctccgcggccgcggccgccgccgaggtcgaaggccgagggctgggcgtgcgcggcaccagcgcgtcctgcgagccgtcctcgtcctcggactcgaggcggcagcgagcccgcttcttcgggggcgcgcggggcggcggcggcgggggcggcggcgacggagacggggacgagacatcgtccagggtgggaggacggcgggccgcgccgcgtccgcgctcgggggtggtttcgcgctggtcctcttcccgactggccatctcccactgctccttctcctataggcagaaagagatcatggagtctctcatgcaagtcgagaaggaggaggacagcctaaccaccaccaccattaccaccctacccggcgacgcagccccgatcgagaaggaagtgttgatcgagcaggacccgggttttgtgagcgaagaggaggatgaggaggatgaaaaggagaaggataccgccgcctcagtgccaaaagaggataaaaagcaagaccaggacgacgcagagacagatgaggcagcagtcgggcggggggacggaaggcatgatgatgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccacacgtgccccccaagcgccgggagaacggcacctgcgagcccaacccgcgcctcaacttctacccggtcttcgcggtacccgaggtgctggccacctaccacatcttcttccaaaactgcaagatccccctctcctgccgcgccaaccgcacccgcgccgacaagacgctggccctgcggcagggcgcccacatacctgatatcgcctctctggaggaggtgcccaagatcttcgagggtctcggtcgcgacgagaaacgggcggcgaacgctctgcaaggagacagcgaaaacgagagtcactcgggggtgctggtggagctcgagggcgacaacgcgcgcctggccgtgctcaagcgcagcatcgaagtcacccacttcgcctacccggcgctcaacctgccccccaaggtcatgagtgtggtcatgagtgagctcatcatgcgccgcgcccagcccctggacgcggatgcaaacttgcaagagccctccgaggaaggcctgcccgcggtcagcgacgagcagctggcgcgctggctggagacccgcgaccccgcccagctggaggagcggcgcaagctcatgatggccgcggtgctcgtcaccgtggagctcgagtgtctgcagcgcttcttcggggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacgtccgcgactgcgtctacctcttcctctgctacacgtggcagacggccatgggggtctggcagcagtgcctggaggagcgcaacctcaaggagctggagaagctcctccggcgcgccctcagggacctctggacgggcttcaacgagcgctcggtggccgccgcgctggcggacatcatcttccccgagcgcctgctcaaaaccctgcagcagggcctgcccgacttcaccagccagagcatgctgcagaacttcaggaccttcatcctggagcgctcgggcatcctgccggccacctgctgcgcgctgcccagcgacttcgtgcccatcaggtacagggagtgcccgccgccgctctggggccactgctacctcttccagctggccaactacctcgcctaccactcggatctcatggaagacgtgagcggcgagggcctgctcgagtgccactgccgctgcaacctgtgcacgccccaccgctctctagtctgcaatccgcagctgctcagcgagagtcagattatcggtaccttcgagctgcagggtccctcgcccgacgaaaagtccgcggctccggggttgaaactcactccggggctgtggacttccgcctacctacgcaaatttgtacctgaagactaccacgcccacgagatcaggttttacgaagaccaatcccgcccgcccaaggcggagctcaccgcctgcgtcattacccagggccacatcctgggccaattgcaagccatcaacaaagcccgccaagagttcttgctgaaaaagggtcggggggtgtacctggacccccagtccggcgaggagctaaacccgctacccccgccgccgccccagcagcgggaccttgcttcccaggatggcacccagaaagaagcagccgccgccgccgccagcatacatgcttctggaggaagaggaggactgggacagtcaggcagaggaggtttcggacgaggacgaggaggaggagatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtccaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggggtggcttttccccgcaatgtcctgcattactaccgtcatctctacagcccctactgcggcggcagcggcgacccagagggagcggcggcagcagcagcgccagccacagcggcgaccacctaggaagacctccgcgggcaagacggcgggagccgggagacccgcggcggcggcggtagcggcggcggcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgcgcccttctcgaatttaggcgggagaaagactacgtcatcgccgaccgccgcccagcccacccagccgacatgagcaaagagattcccacgccctacatgtggagctaccagccgcagatgggactcgcggcgggagcggcccaagactactccacccgcatgaactacatgagcgcggggccccacatgatctcacgggttaatgggatccgcgcccagcgaaaccaaatactgctggaacaggcggccataaccgccacaccccgtcatgacctcaatccccgaaattggcccgccgccctcgtgtaccaggaaaccccctctgccaccaccgtggtacttccgcgtgacacccaggccgaagtccagatgactaactcaggggcgcagctcgcgggcggctttcgtcacggggtgcggccgcaccggccgggtatattacacctggcgatcagaggccgaggtattcagctcaacgacgagtcggtgagctcttcgctcggtctccgtccggacggaaccttccagatcgccggatcaggtcgctcctcattcacgcctcgccaggcgtatctgactctgcagacctcctcctcggagcctcgctccggcggcatcggcaccctccagttcgtggaggagttcgtgccctcggtctacttcaaccccttctcgggacctcccggacgctaccccgaccagttcatcccgaactttgacgcggtgaaggactcggcggacggctacgactgaatgtcaagtgctgaggcagagagcgttcgcctgaaacacctccagcactgccgccgcttcgcctgctttgcccgcagctccggtgagttctgctactttcagctgcccgaggagcataccgaggggccggcgcacggcgtccgcctaaccacccagggcgaggttacctgtacccttatccgggagtttaccctccgtcccctgctagtggagcgggagcggggttcttgtgttataactatcgcctgcaactgccctaaccctggattacatcaagatctttgttgtcacctgtgtgctgagtataataaacgctgagatcagactctactggggctcctgtcgccatcctgtgaacgccaccgtcttcacccaccccgagcagccccaggcgaacctcacctgcggcctgcgtcggagggccaagaagtacctcacctggtacttcaacggcaccccctttgtggtttacaacagcttcgaccaggacggagttgccttgagagacgacctttccggtctcagctactccattcacaagaacaccaccctccacctcttccctccctacctgccgggaacctacgagtgcgtcaccggccgctgcacccacctcctccgcctgatcgtaaaccagacctttccgggaacacacctcttccccagaacaggaggtgagctcaggaaaccccctggggcccagggcggagacttaccttcgacccttgtggggttaggattttttatcgccgggttgctggctctcctgatcaaagcttccttcagatttgttctctccctttacttttatgaacagctcaacttctaataacactaccttttctcagggatcgggtagtaacttctcttctgaaatcgggctgggtgtgctgcttactctgttgatttttttccttatcatacttagccttctgtgcctcaggctcgccgcctgctgcgcacatatctacatctacagcaggttgcttaactgctggggtcgccatccaagatgaacggggctcaggtgctatgtctgctggccctggtggcctgcagtgccgccgtcaattttgaggaacccgcttgcaatgtgactttcaagcctgagggcgcacattgcaccactctggttaaatgtgtgacctctcatgaaaaactgctcatcgcctacaaaaacaaaacaggcgagttcgcggtctatagtgtgtggcaacccggagaccataataactactcagtcaccgtcttcgagggtgcggagtctaagaaattcgattacacctttcccttcgaggagatgtgtgatgcggtcatgtacctgtccaaacagtacaagctgtggccccccacccccgaggcgtgtgtggaaaacactgggtctttctgctgtctctctctggcaatcactgtgcttgctctaatctgcacgctgctatacatgagattcaggcagaggcgaatctttatcgatgagaaaaaaatgccttgatcgctaacaccggctttctgtctgcagaatgaaagcaatcacctccctactaatcagcaccaccctccttgcgattgcccatgggttgacacgaatcgaagtgccagtggggtccaatgtcaccatggtgggccccgccggcaattcctccctgatgtgggaaaaatatgtccgtaatcaatgggatcattactgctctaatcgaatctgtatcaagcccagagccatctgcgacgggcaaaatctaactttgattgatgtgcaaatgacggatgctgggtactattacgggcagcggggagaaatgattaattactggcgaccccacaaggactacatgctgcatgtagtcaaggcagtccccactactaccacccccaccactaccactcccactactaccacccccactactaccactagcactgctactaccgctgcccgcaaagctattacccgcaaaagcaccatgcttagcaccaagccccattctcactcccacgccggcgggcccaccggtgcggcctcagaaaccaccgagctttgcttctgccaatgcactaacgccagcgcccacgaactgttcgacctggagaatgaggacgatgaccagctgagctccgcttgcccggtcccgctgcccgcagagccggtcgccctgaagcagatcggtgatccatttattgactctcctgtttatccctctcccgaataccctcccgactctaccttccacatcacgggcaccaacgaccccaacctctccttctacctgatgctgctgctttgtatctctgtggtatcttccgcgctcatgttactgggcatgttctgctgcctcatctgccgcagaaaaagaaagtctcgctctcagggccaaccactgatgcccttcccctaccccccagattttgcagataacaagatatgagcacgctgctgacactaaccgctttactcgcctgcgctctaacccttgtcgcttgcgaatccagataccacaatgtcacagttgtgacaggagaaaatgttacattcaactccacggccgacacccagtggtcgtggagcggccacggtagctatgtatacatctgcaatagctccacctcccctagcatgtcctctcccaagtaccactgcaatgccagtctgttcaccctcatcaacgcctccacctcggacaatggactctatgtaggctatgtgacacccggtgggcagggaaagacccacgcctacaacctgcaagttcgccacccctccaccaccgccaccacctctgccgcccctacccgcagcagcagcagcagcagcagcagcagcagcagattcctgactttaatcctagccagctcaacaaccaccgccaccgctgacaccacccacagctccgcgcccgaaaccacccacacccaccacccagagacgaccgcggcctccagcgaccagatgtcggccaacatcaccgcctcggatcttgaacttgcttcaacccccaccccaaaaccagtggatgcagccgacgtctccgccctcgtcaatgactgggcggggctgggaatgtggtggttcgccataggcatgatggcgctctgcctgcttctgctctggctcatctgctgcctcaaccgcaggcgggccagacccatctatagacccatcattgttctcaaccccgctgatgatgggatccatagattggatggtctgaaaaacctacttttctcttttacagtatgataaattgagacatgcctcgcattttcatgtacttgacacttctcccactttttctggggtgttctacgctggccgccgtctctcacctcgaggtagactgcctcacacccttcactgtctacctgatttacggattggtcaccctcactctcatctgcagcctaatcacagtagtcatcgccttcatccagtgcattgactacatctgtgtgcgcctcgcatacctgagacaccacccgcagtaccgagacagaaacattgcccaactcctaagactgctctaatcatgcataagactgtgatctgcctcctcatcctcctctccctgcccgctctcgtctcatgccagcccaccacaaaacctccacgaaaaagacatgcctcctgtcgcttgagccaactgtggaatattcccaaatgctacaatgaaaagagcgagctttccgaagcctggctatatgcggtcatgtgtgtccttgtcttctgcagcacaatctttgccctcatgatctacccccactttgatttgggatggaatgcggtcgatgccatgaattaccctacctttcccgcgcccgatatgattccactccgacaggttgtggtgcccgtcgccctcaatcaacgccccccatcccctacacccactgaggtcagctactttaatctaacaggcggagatgactgacactctagatctagaaatggacggcatcggcaccgagcagcgtctcctacagaggcgcaagcaggcggctgaacaagagcgcctcaatcaggagctccgagatctcattaacctgcaccagtgcaaaaaaggcatcttttgcctggtcaagcaggccgatgtcacctacgagaaaaccggtaacagccaccgcctcagctacaagctgcccacccaacgccagaagttggtgctcatggtgggtcagaatcccatcaccgtcacccagcactcggtggagaccgaggggtgtctgcactccccctgtcagggtccggaagacctctgcaccctggtaaagaccctgtgtggtcttagagatttaatcccctttaactaatcaaacactggaatcaataaaaagaatcacttactttaaatcagtcagcaggtctctgtccactttattcagcagcacctccttcccctcctcccaactctggtactccaaacgcctcctggcggcaaacttcctccacaccctgaagggaatgtcagattcttgctcctgtccctccgcacccactatcttcatgttgttgcagatgaagcgcgccaaaacgtctgacgagaccttcaaccccgtgtacccctatgacacggaaaacgggcctccctccgtccctttcctcacccctcccttcgtgtcccccgacggatttcaagaaagccccccaggggtcctgtctctgcgcctgtcagagcccctggtcacttcccacggcatgcttgccctgaaaatgggaaatggcctctccctggatgacgccggcaacctcacctctcaagatgtcaccaccgtcacccctcccctcaaaaaaaccaagaccaacctcagcctccagacctcagcccccctgaccgttagctctgggtccctcaccgtcgcggccgccgctccactggcggtggccggcacctctctcaccatgcaatctcaggcccccttgacagtgcaagatgcaaaactcggcctggccacccagggacccctgaccgtgtctaaaggcaaactcaccttgcagacatcggctccactgacggccgctgacagcagcactctcactgttagtgccacacctcccctcagcacaagcaatggtagtttgagcattgacatgcaggccccgatttataccaccaatggaaaactggcacttaacattggtgctcccctgcatgtggtagacaccctaaatgcactaactgtagtaactggccagggtcttaccataaatggaaaagccctgcaaactagagtcacgggtgccctcagttatgacacagaaggcaacatccaactgcaagccggagggggtatgcgcattgacaataatggccaacttatccttaatgtagcttatccatttgatgctcaaaacaacctcagccttagacttggccaaggtcccctaattgttaactctgcccacaacttggatcttaaccttaacagaggcctttacttatttacatctggaaacacgaaaaaactggaagttaacataaaaacagccaaaggtctattttacgatggcaccgctatagcaatcaatgcaggtgacgggctacagtttgggtctggttcagatacaaatccattgcaaactaaacttggattggggctggaatatgactccaacaaagctataatcaccaaacttggaactggcctaagctttgacaacacaggtgccatcacagtaggcaacaaaaatgatgacaagcttaccttgtggaccacaccagacccctccccaaactgcagaattaattcagaaaaagatgctaaactcacactagttttgactaaatgcggcagccaggtgttagccagcgtttctgttttatctgtaaaaggcagccttgcccccatcagcggcacagtaactagcgcccagattgttttaagatttgatgaaaacggagttttattgagcaattcttctcttgacccccaatactggaactatagaaaaggcgattctacagaaggcactgcatatactaatgctgtgggatttatgcccaacctcacagcataccctaaaacacagagccagactgctaaaagcaacattgtaagtcaagtttacttgaatggggacaaaacaaaacccatgaccctaaccatcaccctcaatggaactaatgaaacaggggatgctacagtaagcacatactccatgtcattttcatggaactggaatggaagtaattacattaatgacaccttccaaaccaactcctttaccttctcctacatcgcccaagaataaaaaagcatgacgctttgttctctgattcagtgtgtttcttttattttttttcaattacaacagaatcattcaagtcattctccatttagcttaatagacccagtagtgcaaagccccatactagcttatttcagacagtataaattaaaccataccttttgatttcaatattaaaaaaatcatcacaggatcctagtggtcaggccgccccctcccttccaagacacagaatacacaatcctctccccccggctggctttaaacaacaccatctgattggtgacagacaggttcttcggggttatattccacacggtctcctggcgggccaggcgctcgtcggtgatgctgataaactctcccggcagctcgctcaagttcacgtcgctgtccagcggctgaacctcatgctgacgcggtaactgcgcgaccggctgctgaacaaacggaggcctcgcctacaagggggtagagtcatagtcctccgtcaggatagggcggttatgcagcagcagcgagcgaatcatctgctgccgccgccgctccgtccggcaggaaaacaacatcccggtggtctcctccgctataatccgcaccgcccgcagcataagcctcctcgttctccgcgcgcagcaccgcaccctgatctcgctcaggttggcgcagtaggtacagcacatcaccacgatgttattcatgatcccacagtgcaaggcgctgtatccaaagctcatgcccgggaccaccgcccccacgtgaccgtcgtaccagaagcgcaggtaaatcaagtgccgacccctcatgaacgtgctggacataaacatcacctccttgggcatgttgtaattcaccacctcccggtaccagatgaatctctgattgaacacggccccttccaccaccatcctgaaccaagaggctaggacctgcccaccggctatgcactgcagggaacccgggttggaacaatgacaatgcaaactccagggctcgtaaccgtggatcatccggctgctgaagacatcgatgttggcgcaacacagacacacgtgcatacacttcctcatgattagcagctcctccctcgtcaggatcatatcccaagggataacccattcttgaatcaacgtaaagcccacagagcagggaaggcctcgcacataactcacgttgtgcatggtcagcgtgttgcattccggaaacagcggatgatcctccagtatcgaggcgcgggtctcgttctcacagggaggtaaaggggccctgctgtacggactgtggcgggacgaccgagatcgtgttgagcgtaacgtcatggaaaagggaacgccggacgtggtcatacttcttgaagcaaaaccaggctcgcgcgtgacagacctccttgcgtctacggtctcgccgcttagctcgctccgtgtgatagttgtagtacagccactctctcaaagcgtcgaggcgacacctggcgtcaggatgtatgtagactccgtcttgcaccgcggccctgataatatccaccaccgtagaataagccacaccaagccaagcaatacactcgctctgcgagcggcagacaggaggagcggggagagacggaaggaccatcataaaattttaaagaatattttccaatatttcgaaatcaagatctaccaaatggcagcgctcccctccactggcgcggtcaaactctacggccaaagaacagataacggcatttttaagatgttcccggacggcgtctaaaagacaaaccgctctcaagtcgacataaattataagccaaaagccatcgggttcaagatccactatggacgcgccggcggcgtccaccaaacccaaataattttcttctctccagcgctgcaaaatcccagtaagcaactccctgatattaagatgaaccatgccaaaaatctgttcaagagcgccctccaccttcattctcaagcagcgcatcatgattgcaaaaattcaggttcctcagacacctgtatgagattcaaaacgggaatattaacaaaaattcctctgtcgcgcagatcccttcgcagggcaagctgaacataatcagacaggtctgaacgaaccagcgaggccaaatccccgccaggaaccagatccagagaccctatgctgattatgacgcgcatactcggggctatgctaaccagcgtagcgccgatgtaggcgtgctgcatgggcggcgaaataaaatgcaaggtgctggttaaaaaatcaggcaaagcctcgcgcaaaaaagctaagacatcataatcatgctcatgcaggtagttgcaggtaagctcaggaaccaaaacggaataacacacgattttcctttcaaacatgacttccaggtgactgcataagaaaaaaattataaataataaatattaattaaataaattaaacattggaagcctgtctcacaacaggaaaaaccactctgatcaacataagacgggccacgggcatgcccgcgtgaccataaaaaaatcggtctccgtgattacaaagcaccacagatagctccccggtcatgtcgggggtcatcatgtgagactgtgtatacacgtccgggctgttgacatcggtcaaagaaagaaatcgagctacatagcccggaggaatcaacacccgcacgcggaggtacagcaaaacggtccccataggaggaatcacaaaattagtaggagaaaaaaaaacataaacaccagaaaaaccctcttgccgaggcaaaacagcgccctcccgttccaaaacaacataaagcgcttccacaggagcagccatgacaaagacccgagtcttaccaggaaaattttaaaaaagattcctcaacgcagcaccagcaccaacacctgtcagtgtaaaatgccaagcgccgagcgagtatatataggaataaaaagtgacgtaaacggttaaagtccagaaaacgcccagaaaaaccgcacgcgaacctacgccccgaaacgaaagccaaaaaacactaaacacgccctttcggcgtcaacttccggtttcccacgatacgtcacttccgcatatataaaactacgctacccaacatgcaagaagccacgccccaaaaaacgtcacacctcccggcccgccccgcgccgccgctcctccccgccccgccccgctccgcccacctcattatcatattggcttcaatccaaaataaggtatattattgatgatg

SEQ ID NO: 107 - protein, 805 aa, Ape adenovirus AH6
MQVEKEEDSLTTTTITTLPGDAAPIEKEVLIEQDPGFVSEEEDEEDEKEKDTAASVPKEDKKQDQDDAETDEAAVGRGDGRHDDDDGYLDVGDDVLLKHLHRQCVIVCDALQERCEVPLDVAEVSRAYERHLFAPHVPPKRRENGTCEPNPRLNFYPVFAVPEVLATYHIFFQNCKIPLSCRANRTRADKTLALRQGAHIPDIASLEEVPKIFEGLGRDEKRAANALQGDSENESHSGVLVELEGDNARLAVLKRSIEVTHFAYPALNLPPKVMSVVMSELIMRRAQPLDADANLQEPSEEGLPAVSDEQLARWLETRDPAQLEERRKLMMAAVLVTVELECLQRFFGDPEMQRKLEETLHYTFRQGYVRQACKISNVELCNLVSYLGILHENRLGQNVLHSTLKGEARRDYVRDCVYLFLCYTWQTAMGVWQQCLEERNLKELEKLLRRALRDLWTGFNERSVAAALADIIFPERLLKTLQQGLPDFTSQSMLQNFRTFILERSGILPATCCALPSDFVPIRYRECPPPLWGHCYLFQLANYLAYHSDLMEDVSGEGLLECHCRCNLCTPHRSLVCNPQLLSESQIIGTFELQGPSPDEKSAAPGLKLTPGLWTSAYLRKFVPEDYHAHEIRFYEDQSRPPKAELTACVITQGHILGQLQAINKARQEFLLKKGRGVYLDPQSGEELNPLPPPPPQQRDLASQDGTQKEAAAAAASIHASGGRGGLGQSGRGGFGRGRGGGDDGRLGGGQPRRGSFRGRRGGRRNTITLGRSPLAGAPEILRPQQQRYNLRSSGAGAHPQQTQP

SEQ ID NO: 108 - protein, 151 aa, Ape adenovirus AH6
MRADREELDLPPPVGGVAVDVVKVEVPSAGRALVLAFVKASAVLAALHGLYLLHEMHLPTADEEAEWESEPPAWLAAWLVLFYFGCVAVTVWLLEGCYGGADHHAARAAGPDIGARRSEFDDDIAQLGAVHGLELPRRRQVSREFLQVYLA

SEQ ID NO: 109 - protein, 207 aa, Ape adenovirus AH6
MAPRKKQPPPPPAYMLLEEEEDWDSQAEEVSDEDEEEEMMEDWEEDSLDEEASEAEEVADATPSPSAAAPSPAPPKSSDPSSSAITSAPPAPAPTRSRPNRRWDTTGTGVGKSKCPPAPPPQQEQQQQQRRQGYRSWRGHKNAIVACLQDCGGNISFARRFLLFHHGVAFPRNVLHYYRHLYSPYCGGSGDPEGAAAAAAPATAATT

SEQ ID NO: 110 - protein, 239 aa, Ape adenovirus AH6
MAPRKKQPPPPPAYMLLEEEEDWDSQAEEVSDEDEEEEMMEDWEEDSLDEEASEAEEVADATPSPSAAAPSPAPPKSSDPSSSAITSAPPAPAPTRSRPNRRWDTTGTTAPTAAAAATQRERRQQQRQPQRRPPRKTSAGKTAGAGRPAAAAVAAAAGALRLSPNEPLSTRELRHRIFPTLYAIFQQSRGQEQELKIKNRSLRSLTRSCLYHKSEDQLRRTLEDAEALFSKYCALTLKD

SEQ ID NO: 111 - protein, 420 aa, Ape adenovirus AH6
MHPVLRQMRPPPQQQQQQHQQERHQQQRESCRAPSPTLGGPATSASAAVSGAGGGGLADDPEEPPRRRARQYLDLEEGEGLARLGAPSPERHPRVQLKRDSREAYVPRQNLFRDRAGEEPEEMRDRRFAAGRELRQGLNRERLLREEDFEPDARTGISPARAHVAAADLVTAYEQTVNQEINFQKSFNNHVRTLVAREEVTIGLMHLWDFVSALEQNPNSKPLTAQLFLIVQHSRDNEAFRDALLNITEPEGRWLLDLINILQSIVVQERSLSLADKVAAINYSMLSLGKFYARKIYQTPYVPIDKEVKIDGFYMRMALKVLTLSDDLGVYRNERIHKAVSVSRRRELSDRELMHSLQRALAGAGSGDREAESYFEAGADLRWVPSRRALEAAGARREDYADEEEEDDEEYELEEGEYLD

SEQ ID NO: 112 - protein, 545 aa, Ape adenovirus AH6
MASREEDQRETTPERGRGAARRPPTLDDVSSPSPSPPPPPPPPRAPPKKRARCRLESEDEDGSQDALVPRTPSPRPSTSAAAAAAELANAPRKKKRQRATVLRSPSPEVIVDSEDEQEEAALVMVGFSNPPVRIKQGRSGKRSVRRLQEDDPVVRGLRAGGEEEEEEEEENSGAESESAAAAATVVNPLSLPLVSAWEKGMEAARALMDKYHVENELKLNFKMLPDQVEALAAVCKAWLNEEHRGLQLTFSSNKTFVTMMGRFLQAYLQSYAEVTYKHFEPTGCALWQHRCTEVEGELKCLHGSSMVNKEHVIEMDVTSENGQRALKEQASKAKIVKNRWGRNVVQIANTDARCCLHDASCPANQFSGKSCGMFFSEGAKAQMAFRQMEAFMRALYPNAESGRGHLLIPLRCDCNSKPGHAPFLGRQVPKLTPFALSNAEDLDAELISDRSVLASVNYPALLVFQCCNPVYRNSRAQGGGPNCDFKISAPDLMNALVLTRGLWADNFPDLPRMVVPEFKWGTRYQFRNVSLPVAHGDSRQNPFDF

SEQ ID NO: 113 - protein, 188 aa, Ape adenovirus AH6
MEAWECLESFAEVRALLEESSNNTSGWWRYFWGSPQAKLVCRIKEDYKWEFEQLLKSCGELLDSLNLGHQALFQDKIIRTLDFSTPGRVAAGVAFLAFLKDKWSEETHLSSGYVLDFLAIQLWRAWIRHKNRMQLLSSVRPLLIQPEEQQTGPEDRARPEPEERAPAAAPERSAWNLGAGLNGHPHRE

SEQ ID NO: 114 - protein, 508 aa, Ape adenovirus AH6
MERRDPLEFGIRPGFSGHTTVEGMDQAQEQNATVVFRPSVADSAGGAADRAGGPGSSGTRGEGTRGGAGEERVEPGSRPERPSTSGVNVGQVADLFPELRRILTIREDGQFVKGLKRERGASEHNEEASNLAFSLMTRHRPECITFQQIKDNCANELDLLGQKYSIEQLTTYWLQPGDDLEEAIRVYAKVALRPDCKYKLKGLVNIRNCCYISGNGAEVEIETDDRVAFRCSMMNMWPGVLGMDGVVIMNVRFTGPNFNGTVFLGNTNLVLHGVSFYGFNNTCVEAWTDVKVRGCAFYGCWKAVVCRPKSRSSIKKCLFERCTLGVLAEGNCRVRHNVASECGCFMLVKSVAVIKHNMVCGNSEDKASQMLTCSDGNCHLLKTIHITSHSRKAWPVFEHNVLTRCSLHLGNRRGVFLPYQCNLSHTKVLLEPESMSKVNLNGVFDMTLKIWKVLRYDETRSRCRPCECGGKHMRNQPVMLDVTEELRPDHLVLACTRAEFGSSDEDTD

SEQ ID NO: 115 - protein, 174 aa, Ape adenovirus AH6
GQGKTHAYNLQVRHPSTTATTSAAPTRSSSSSSSSSSRFLTLILASSTTTATADTTHSSAPETTHTHHPETTAASSDQMSANITASDLELASTPTPKPVDAADVSALVNDWAGLGMWWFAIGMMALCLLLLWLICCLNRRRARPIYRPIIVLNPADDGIHRLDGLKNLLFSFTV

SEQ ID NO: 116 - protein, 105 aa, Ape adenovirus AH6
MSSAEAESVRLKHLQHCRRFACFARSSGEFCYFQLPEEHTEGPAHGVRLTTQGEVTCTLIREFTLRPLLVERERGSCVITIACNCPNPGLHQDLCCHLCAEYNKR

SEQ ID NO: 117 - protein, 128 aa, Ape adenovirus AH6
MTDTLDLEMDGIGTEQRLLQRRKQAAEQERLNQELRDLINLHQCKKGIFCLVKQADVTYEKTGNSHRLSYKLPTQRQKLVLMVGQNPITVTQHSVETEGCLHSPCQGPEDLCTLVKTLCGLRDLIPFN

SEQ ID NO: 118 - protein, 159 aa, Ape adenovirus AH6
MNGAQVLCLLALVACSAAVNFEEPACNVTFKPEGAHCTTLVKCVTSHEKLLIAYKNKTGEFAVYSVWQPGDHNNYSVTVFEGAESKKFDYTFPFEEMCDAVMYLSKQYKLWPPTPEACVENTGSFCCLSLAITVLALICTLLYMRFRQRRIFIDEKKMP

SEQ ID NO: 119 - protein, 68 aa, Ape adenovirus AH6
MNSSTSNNTTFSQGSGSNFSSEIGLGVLLTLLIFFLIILSLLCLRLAACCAHIYIYSRLLNCWGRHPR

SEQ ID NO: 120 - protein, 300 aa, Ape adenovirus AH6
MKAITSLLISTTLLAIAHGLTRIEVPVGSNVTMVGPAGNSSLMWEKYVRNQWDHYCSNRICIKPRAICDGQNLTLIDVQMTDAGYYYGQRGEMINYWRPHKDYMLHVVKAVPTTTTPTTTTPTTTTPTTTTSTATTAARKAITRKSTMLSTKPHSHSHAGGPTGAASETTELCFCQCTNASAHELFDLENEDDDQLSSACPVPLPAEPVALKQIGDPFIDSPVYPSPEYPPDSTFHITGTNDPNLSFYLMLLLCISVVSSALMLLGMFCCLICRRKRKSRSQGQPLMPFPYPPDFADNKI

SEQ ID NO: 121 - protein, 271 aa, Ape adenovirus AH6
MSTLLTLTALLACALTLVACESRYHNVTVVTGENVTFNSTADTQWSWSGHGSYVYICNSSTSPSMSSPKYHCNASLFTLINASTSDNGLYVGYVTPGGQGKTHAYNLQVRHPSTTATTSAAPTRSSSSSSSSSSRFLTLILASSTTTATADTTHSSAPETTHTHHPETTAASSDQMSANITASDLELASTPTPKPVDAADVSALVNDWAGLGMWWFAIGMMALCLLLLWLICCLNRRRARPIYRPIIVLNPADDGIHRLDGLKNLLFSFTV

SEQ ID NO: 122 - protein, 133 aa, Ape adenovirus AH6
MHKTVICLLILLSLPALVSCQPTTKPPRKRHASCRLSQLWNIPKCYNEKSELSEAWLYAVMCVLVFCSTIFALMIYPHFDLGWNAVDAMNYPTFPAPDMIPLRQVVVPVALNQRPPSPTPTEVSYFNLTGGDD

SEQ ID NO: 123 - protein, 294 aa, Ape adenovirus AH6
MTTSGVPFSMTLRSTRSRSSRHSPYSRAPLPPCENETRASILEDHPLFPECNTLTMHNVSYVRGLPCSVGFTLIQEWVIPWDMILTREELLIMRKCMHVCLCCANIDVFSSRMIHGYEPWSLHCHCSNPGSLQCIAGGQVLASWFRMVVEGAVFNQRFIWYREVVNYNMPKEVMFMSSTFMRGRHLIYLRFWYDGHVGAVVPGMSFGYSALHCGIMNNIVVMCCTYCANLSEIRVRCCARRTRRLMLRAVRIIAEETTGMLFSCRTERRRQQMIRSLLLHNRPILTEDYDSTPL

SEQ ID NO: 124 - protein, 128 aa, Ape adenovirus AH6
MAAPVEALYVVLEREGAVLPRQEGFSGVYVFFSPTNFVIPPMGTVLLYLRVRVLIPPGYVARFLSLTDVNSPDVYTQSHMMTPDMTGELSVVLCNHGDRFFYGHAGMPVARLMLIRVVFPVVRQASNV

SEQ ID NO: 125 - protein, 115 aa, Ape adenovirus AH6
MMRCLRMKVEGALEQIFGMVHLNIRELLTGILQRWREENYLGLVDAAGASIVDLEPDGFWLIIYVDLRAVCLLDAVREHLKNAVICSLAVEFDRASGGERCHLVDLDFEILENIL

SEQ ID NO: 126 - protein, 121 aa, Ape adenovirus AH6
MVLPSLPAPPVCRSQSECIAWLGVAYSTVVDIIRAAVQDGVYIHPDARCRLDALREWLYYNYHTERAKRRDRRRKEVCHARAWFCFKKYDHVRRSLFHDVTLNTISVVPPQSVQQGPFTSL

SEQ ID NO: 127 - protein, 130 aa, Ape adenovirus AH6
MFERKIVCYSVLVPELTCNYLHEHDYDVLAFLREALPDFLTSTLHFISPPMQHAYIGATLVSIAPSMRVIISIGSLDLVPGGDLASLVRSDLSDYVQLALRRDLRDRGIFVNIPVLNLIQVSEEPEFLQS

SEQ ID NO: 128 - protein, 577 aa, Ape adenovirus AH6
MKRAKTSDETFNPVYPYDTENGPPSVPFLTPPFVSPDGFQESPPGVLSLRLSEPLVTSHGMLALKMGNGLSLDDAGNLTSQDVTTVTPPLKKTKTNLSLQTSAPLTVSSGSLTVAAAAPLAVAGTSLTMQSQAPLTVQDAKLGLATQGPLTVSKGKLTLQTSAPLTAADSSTLTVSATPPLSTSNGSLSIDMQAPIYTTNGKLALNIGAPLHVVDTLNALTVVTGQGLTINGKALQTRVTGALSYDTEGNIQLQAGGGMRIDNNGQLILNVAYPFDAQNNLSLRLGQGPLIVNSAHNLDLNLNRGLYLFTSGNTKKLEVNIKTAKGLFYDGTAIAINAGDGLQFGSGSDTNPLQTKLGLGLEYDSNKAIITKLGTGLSFDNTGAITVGNKNDDKLTLWTTPDPSPNCRINSEKDAKLTLVLTKCGSQVLASVSVLSVKGSLAPISGTVTSAQIVLRFDENGVLLSNSSLDPQYWNYRKGDSTEGTAYTNAVGFMPNLTAYPKTQSQTAKSNIVSQVYLNGDKTKPMTLTITLNGTNETGDATVSTYSMSFSWNWNGSNYINDTFQTNSFTFSYIAQE

SEQ ID NO: 129 - protein, 955 aa, Ape adenovirus AH6
MATPSMMPQWSYMHISGQDASEYLSPGLVQFARATDSYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNPCEWDEAVTAVDINLDELGEDEDDAEGEAEQQKTHVFGQAPYSGQNITKEGIQIGVDTTSQAQTPLYADKTFQPEPQVGESQWNETEINYGAGRVLKKTTLMKPCYGSYARPTNENGGQGILLEKEGGKPESQVEMQFFSTTQAAAAGNSDNLTPKVVLYSEDVHLETPDTHISYMPTSNEANSRELLGQQAMPNRPNYIAFRDNFIGLMYYNSTGNMGVLAGQASQLNAVVDLQDRNTELSYQLLLDSMGDRTRYFSMWNQAVDSYDPDVRIIENHGTEDELPNYCFPLGGIINTETLTKVKPKTGQDAQWEKDTEFSEKNEIRVGNNFAMEINLNANLWRNFLYSNVALYLPDKLKYTPANVQISSNSNSYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLIQMLANYNIGYQGFYIPESYKDRMYSFFRNFQPMSRQVVDETKYKDYQQVGIIHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 130 - protein, 450 aa, Ape adenovirus AH6
METRGGRRPAALQHQQDQSQAHPGQRPARGAPLHRDPDHPDEDPAPMEGHDSGRAGRPSPGALQRKPPQPAKRGDMLDRDAVEHVTELWDRLELLGQTLKNMPTADGLKPLKNFASLQELLSLGGERLLADLVEENKRVRDMLNEVAPLLRDDGSCSSLNYQLQPVIGVIYGPTGCGKSQLLRNLLSSQLISPAPETVFFIAPQVDMIPPSEIKAWEMQICEGNYAPGPEGTIIPQSGTLRPRFIKMAYDDLTLEHNYDVSDPRNIFAQAASRGPIAIIMDECMENLGGHKGVSKFFHAFPSKLHDKFPKCTGYTVLVVLHNMNPRRDLGGNIANLKIQSKMHIISPRMHPSQLNRFVNTYTKGLPLAIGLLLKDIFRHHAQRSCYDWIIYNTTPEHEALQWCYLHPRDGLMPMYLNVQSHLYHVLEKIHRTLNDRERWTRAYRARKIMK

SEQ ID NO: 131 - protein, 147 aa, Ape adenovirus AH6
MSGSSSSNALDGSIVSPYLTTRMPHWAGVRQNVMGSSIDGRPVLPANSATLTYATVAGTPLDATAAAAATAAASAVRSLATDFAFLGPLATGAAARAAVRDDKLTALLAQLDALTRELGDLSQQVVALRQQVSALQASGNASPANAV

SEQ ID NO: 132 - protein, 584 aa, Ape adenovirus AH6
MRRAAMYHEGPPPSYESVVGAAAASPFASQLEPPYVPPRYLRPTGGRNSIRYSELAPLYDTTRVYLVDNKSADVASLNYQNDHSNFLTTVIQNNDYTPSEASTQTINLDDRSHWGGDLKTILHTNMPNVNEFMFTNKFKARVMVSRSHTKDDRVELKYEWVEFELPEGNYSETMTIDLMNNAIVEHYLKVGRQNGVLESDIGVKFDTRNFRLGLDPVTGLVMPGVYTNEAFHPDIILLPGCGVDFTYSRLSNLLGIRKRQPFQEGFRITYEDLEGGNIPALLDVEAYQDSLKEEEAGEGSGGGAAQEEGGASSETSADAAAAATAAEAEAADPAMVVEEEKDMNDEAVRGDTFATRGEEKKAEAEAAAEEAAAAAAAVEAAAEAEKPPKEPVIKPLTEDSKKRSYNVLKDSTNTEYRSWYLAYNYGDPATGVRSWTLLCTPDVTCGSEQVYWSLPDMMQDPVTFRSTRQVSNFPVVGAELLPVHSKSFYNDQAVYSQLIRQFTSLTHVFNRFPENQILARPPAPTITTVSENVPALTDHGTLPLRNSIGGVQRVTVTDARRRTCPYVYKALGIVSPRVLSSRTF

SEQ ID NO: 133 - protein, 590 aa, Ape adenovirus AH6
MQDPNVVDPALRAALQSQPSGLNSTDDWRQVMDRIMSLTARNPDAFRQQPQANRLSAILEAVVPARANPTHEKVLAIVNALAENRAIRPDEAGLVYDALLQRVARYNSGNVQTNLDRLVGDVREAVAQRERAERQGNLGSMVALNAFLSTQPANVPRGQEDYTNFVSALRLMVTETPQSEVYQSGPDYFFQTSRQGLQTVNLSQAFKNLRGLWGVKAPTGDRATVSSLLTPNSRLLLLLIAPFTDSGSVSRETYLGHLLTLYREAIGQTQVDEHTFQEITSVSRALGQEDTGSLEATLNYLLTNRRQKIPSLHSLTTEEERILRYVQQSVSLNLMRDGVTPSVALDMTARNMEPGMYAAHRPYINRLMDYLHRAAAVNPEYFTNAILNPHWLPPPGFYSGGFEVPEANDGFLWDDMDDSVFSPRPQALAEASLLRLPKKEESRRPSSAAASLSELGAAAARPGSLGGSPFPSLVGSLQSGRTTRPRLLGEDEYLNNSLMQPVREKNLPPAFPNNGIESLVDKMSRWKTYAQEHRDSPVLRPPTRRQRHDRQRGLVWDDEDSADDSSVLDLGGSGGNPFAHLRPRLGRMFQ

SEQ ID NO: 134 - protein, 1206 aa, Ape adenovirus AH6
MALVQVQAHRTRRLHAEAPDPGDQPPRRRLRQQPPGAAPAPARARRRRAAAAPARGTGAPPTSGGPTAAPLLSPATGGDSRSGGGSFTAPRGTVVAPRGCGLLQAIDAATNTPLEFKYHLDLPRALARLCEVNLQELPADLPPPRELQTMDSSQLRDVVIKLRPPRADIWTCGSRGVVVRSTVTPLEEPDGDGHASKVEEHQPGREPCGGLRFPLSFLVRGRQVHLVQEVQPVQRCQYCARFYKSQHECSARRRDFYFHHINSHSSNWWREIQFFPIGSHPRTERLFVTYDVETYTWMGAFGKQLVPFMLVMKFGGDERLVAAARDLALELDWDPWQQDPLTFYCVTPEKMAVGRQFRTFRDRLQTLLARDLWRSFLADNPHLADWALAEHGLASPEELTYEELKKLPSVKGRPRFLELYIVGHNINGFDEIVLAAQVINNRSEVPGPFRITRNFMPRAGKILYNDVTFALPNPRSKKRTDFTLWERGGCDDSDFKHQYLKVMVRDTFALTHTSLRKAAQAYALPVEKGCCAYQAVNQFYMLGSYRSEPDGFPIQEYWKDREEFVLNRELWKKKGQAKYDIIRETLDYCALDVQVTAELVHKLRESYASFVRDAVGLQDASFNVFQRPTISSNSHAIFRQIVFRAERPARTNLGPDLLAPSHELYDYVRASIRGGRCYPTYLGILREPLYVYDICGMYASALTHPMPWGPPLNPYERALAARDWQRALDLQGCKIDYFDARLRPGVFTVDADPPDETQLDPLPPFCSRKGGRLCWTNERLRGEVATSVDLVTLHNRGWRVRLVPDERTTVFPEWRCVAREYVQLNIAAKERADRDKNQTLRSIAKLLSNALYGSFATKLDNKKIVFSDQMDAGTLKGISSGQVNIKSSSFLETDSLSAEVMPAFEREYSPQQLALADSDAEESEDERAPTPFYTPPSGTPGHVAYTYKPITFLDAEEGDMCLHTLEKVDPLVDNDRYPSHLASFVLAWTRAFVSEWSEFLYEEDRGTPLEDRPLKSVYGDTDSLFVTERGHRLMETRGKKRIKKHGGNLVFDPERPELTWLVECETVCGACGADAYSPESVFLAPKLYALKSLQCPACGATSKGKLRAKGHAAEGLDYDTMVKCYLADAQGEDRQRFSTSRTSLKRTLASAQPGAHPFTVTQTTLTRTLRPWKDMTLAALDDHRLVPYSESRPNPRNEEICWIEMP

SEQ ID NO: 135 - protein, 211 aa, Ape adenovirus AH6
MSSGSTEQELKAIVRDLGCGPYFLGTFDKRFPGFVAPHKLACAIVNTAGRETGGVHWLAFAWNPRSKTCYLFDPFGFSDQRLKQIYQFEYEGLLRRSAIASSPDRCVTLEKSTQTVQGPDSAACGLFCCMFLHAFVHWPQSPMDRNPTMNLLTGIPNSMLQSPQVAPTLRRNQERLYSFLERHSPYFRRHSAQIRGATSFCRMQEMQGKMQ

SEQ ID NO: 136 - protein, 653 aa, Ape adenovirus AH6
MALMEHFLPLRNIWNRVRDFPRASTTAAGITWMSRYIYEYHRLMLEDLAPGAPATLRWPLYRQPPPHFLVGYQYLVRTCNDYIFDSRAYSRLRYTEMTQPGHQTVNWSVMANCTYTINTGAYHRFVDLDDFQTTLTQVQQAILAERVVADLALLQPLRGFGVTRMGGRGARRRPRAADAAEMSEEEGEEVPVERLMQDYYKDLRRCQNEAWGMADRLRIQQAGPKDMVLLSTIRRVKTAYFNYIISSTSARHSPHPPPPATVLSLPCDCDWLDAFLERFSDPVDLDSLRSLGGVPTQQLLRCIVSAVSLPHGHPPQHQMTGGVFQLRPRENGRAVTETMRRRRGEMIERFVDRLPVRRRRRRAPPPPPPPPPEEEEAIMEVPEEEEEEEVVMLAEEEIPIAFEREVRDTVAELIRLLEEELTVSARNSQFFNFAVDFYEAMERLEALGDINESTLRRWVMYFFVAEHTATTLNYLFQRLRNYAVFARHVELNLAQVVMRARDDQGGVVYSRVWNEGGLNAFSQLMARISNDLAATVERAGRGDLQEEEIEQFMAEIAYQDNSGDVQEILRQVAVNDTEIDSVELSFRFKLTGPVVFTQRRQIQEINRRVVAFASNLRAQHQLLPARGADVPLPPLPAGPEPPLPPGARPRHRF

SEQ ID NO: 137 - protein, 372 aa, Ape adenovirus AH6
MSKRKIKEEMLQVVAPEIYGPPKKEEQDFKPRKIKRVKKKKKDDDDGEVEFLRATAPRRPLQWKGRRVKRVLRPGTAVVFTPGERSTRTFKRVYDEVYGDEDLLEQANDRSGEFAYGKRHRAMEKDEVLALPLDRGNPTPSLKPVTLQQVLPSSAPSEMKRGLKREGGDLAPTVQLMVPKRQRLEDVLEKMKVDPGLQPDIRVRPIKQVAPGLGVQTVDVVIPTGASSSSAAAATSTADMETQTSSSLVAPAAAAAATSSAEVQTDPWMPPPAAAPSRARRGRRKYGAASALMPEYALHPSIAPTPGYRGYSYRPRRAKGSTRRSRRAATSTRRRSRRRRRQPALAPISVRRVARNGDTLVLPRARYHPSIV

SEQ ID NO: 138 - protein, 259 aa, Ape adenovirus AH6
MEDINFASLAPRHGSRPFLGHWNDIGTSNMSGGAFSWGSLWSGIKNIGSAVKNYGTKAWNSSTGQMLRDKLKEQNFQQKVVEGLASGINGVVDLANQAVQNKINSRLDPRPPVEELPPALETVSPDGRGEKRPRPDREETTLVTHTDEPPPYEEALKQGLPTTRPIAPMATGVVGRHTPATLDLPPPPVSSSAADAQQQKAALPGPPAAAPRPTASRAPLRRAASGPRGVARHSSGNWQNTLNSIVGLGVQSVKRRRCY

SEQ ID NO: 139 - protein, 199 aa, Ape adenovirus AH6
MSILISPSNNTGWGLLRAPSKMFGGARKRSDQHPVRVRGHYRAPWGAHKRGRTGTAGRTTVDEAIDSVVEQARNYTPAVSTVDAAIESVVRGARRYAKAKSRRRRVARRHRRRPGSAAKRAAAALLRRARRTGRRAAMRAARRLAAGITTVAPRARRRAAAAAAAAISDLATRRRGNVYWVRDSVSGTRVPVRFRPPRT

SEQ ID NO: 140 - protein, 227 aa, Ape adenovirus AH6
MSKEIPTPYMWSYQPQMGLAAGAAQDYSTRMNYMSAGPHMISRVNGIRAQRNQILLEQAAITATPRHDLNPRNWPAALVYQETPSATTVVLPRDTQAEVQMTNSGAQLAGGFRHGVRPHRPGILHLAIRGRGIQLNDESVSSSLGLRPDGTFQIAGSGRSSFTPRQAYLTLQTSSSEPRSGGIGTLQFVEEFVPSVYFNPFSGPPGRYPDQFIPNFDAVKDSADGYD

SEQ ID NO: 141 - protein, 80 aa, Ape adenovirus AH6
MALTCRLRFPVPGYRGRSRRRRGMAGRGLSGGSRRAHRRRRATSRRMRGGVLPLLIPLIAAAIGAVPGIASVALQASQRR

SEQ ID NO: 142 - DNA, 37034 bp, Ape adenovirus AH16
catcatcaataatataccttattttggattgtggccaatatgataatgaggtgggcggggcgggtgacgtaggacgcgcgagtagggttgggaggtgtggcggaagtgtggcatttgcaagtgggaggagcttacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggtcctgagcgatgattttccgtctactacccactttagcccacctactcttcacgaactgtacgatctggatgtactggtggatgtgaacgatcccaacgaggaggcggtttctacgttttttcccgagtctgcgcttttggccgcccaggagggatttgacctacacactccgccgctgcctattttagagtctccgctgccggagcccagtggtataccttatatgcctgaactgcttcccgaagtggtagacctgacctgtcacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatttacagtaagttttttatgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacataaacctgttgctattaaagtttgcgggcgacgccctgcagtagagtgcattgaggacttgcttcacgatcccgaggaacctttggacttgagctttaaacgccctaggcaataaaccccagtaataaaccccacctaagtaataaactttaccgcccttggttattgagatgacgcccaatgtttgcttttgaatgacttcatgtgtataataaaagtgagtgtggtcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtctccagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagtcggaggagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgatcagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcaccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaacttcagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagcccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgtagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaattgggggcgaagggtcccggactgggggatgatagtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgcgtaacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgcgcagaccgtctcgcattccaccagccaagtgagttccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaacgacccgtagagggcgttggagagcagcttggcgatggagcgcagggtctggtttttgtcgcggtcggctcgctccttggccgcaatgttgagttgcacgtactcgcgggccacgcacttccactcggggaagacggtggtgcgctcgtctgggatcaggcgcaccctccagccgcggttgtgcagggtgaccatgtcaacgctggtggcgacctcaccgcgcaggcgctcgttggtccagcagaggcggccgcccttgcgcgagcagaaggggggtagggtgtccagctggtcctcgtttggggggtccgcgtcgatggtaaagaccccggggagcaggcgcgggtcaaagtagtcgatcttgcaagcttgcatgtccagagcccgctgccattcgcgggcggcaagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcatgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggctgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggtttacctcgcagagacgggtcaacgcacgggcagtgttaagatggtatctgatttcaaggggcgtgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggtgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttttcccgggggcgcagctcgaagacgccgcctctcatctcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggatatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccaaatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttttattttttagatgcatcccgtgctgcggcagatgcgcccctcgccccggcccgatcagcagcagcaacagcaggcatgcagacccccctctcctcttcccgccccggtcaccacggccgcggcggccgtgtccggcgcggggggcgcgctggagtcagatgagccaccgcggcggcgacctaggcagtatctggacttggaagagggcgagggactggcgcggctgggggcgagctctccagagcgccacccgcgggtgcagttaaaaagggacgcgcgcgaggcgtacctgccgcggcagaacctgtttcgcgaccgcgggggcgaggagcccgaggagatgcgagactgcaggttccaagcagggcgcgagctgcgccgcgggttggacagacagcgcctgctgcgcgaggaggattttgagcccgacatgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaatcccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaagagcgcagcctgagcctggccgagaaggtggcggccattaactattctatgctgagcctgggcaagttctacgcccgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccaagccgccgcgccctggaagcggcgggggcgtacggcggccccctggcggccaatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgttggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaacttcttaagcgcgctgcggctgatggtgaccgaggtccctcagagcgaggtgtaccagtcggggcccgactacttcttccagaccagcagacagggcttgcaaactgtgaacctgagccaggcttttaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggaaatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcaccaatgccattctgaatccccactggatgccccctccgggtttctacaacggggactttgaggtgcccgaggtcaatgacgggttcctctgggatgacatggatgacagtgtgttctcccccaacccgctgcgcgccgcgtctctgcgtttgaaggagggctctgacagggaaggaccgaggagtctggcctcctccctggctctgggggcggtgggcgccacgggcgcggcggcgcggggcagcagccccttccccagcctggcagattcactgaacagcgggcgggtgagcaggccccgtttgctaggcgaggaggagtatctgaacaactccctgctgcagcccgcgagggacaagaacgctcagcggcagcagtttcccaacaacgggatagagagcctggtggacaagatgtccagatggaagacgtatgcgcaggagtacaaggagtgggaggaccgccagccgcggcccctgccgccccctagacagcgttggcagcggcgcgcgtccaaccgccgctggaggcaggggcccgaggacgatgatgactctgcagatgacagcagcgtgttggacctgggcgggagcgggaaccccttttcgcacctgcgcccccgcctgggcaagatgttttaaaagagaagaataaaaaactcaccaaggccatggcgacgagcgttggtttttttgttcccttccttagtatgcggcgcgcggcgatgttcgaggaggggcctcccccctcttacgagagcgcgatgggaatttctcctgcggcgcctctgcagcctccctacgtgcctcctcggtacctgcaacctaccggggggagaaatagcatctgttactctgagctgcagcccctgtacgataccaccaaggtgtacctggtggacaacaaatccgcggacgtggcctccctgaactaccagaacgaccacagcgattttttgaccaccgtgatccaaaacaacgacttcagtccaaacgaggccagcacccagaccataaacctggacaacaggtcgaactggggcggcgacctgaagaccatcttgcacaccaacatgcccaacgtgaatgagttcatgtttaccaactcttttaaggcgcgggtgatggtggcgcgcgacgataagggggtgcctaagtacgagtgggtggacttcacgctgcccgagggcaactactccgagaccatgactcttgacctgatgaacaacgcgatcgtggagcactatttgaaagtagggaggcagaacggggtaaaggagagcgatatcggggttaagtttgacaccagaaacttccgcctgggctgggaccccgagacggggctgatcatgcccggggtctacaccaatgaagcctttcatcccgatatagtgctcctgcccggctgcggggtggacttcactcagagccggctgagcaacctgctgggcgttcgcaagaggcagcctttccaggagggtttcaaaatcacctatgaggatctggaggggggcaacattcccgcgctccttgatctggacgcctatgaggagagcttgaaatccgaggaaagcgggggcggcgctgttgaaggtggcgaggagcaagccggcgacagcggcactgcctcggtagaaaacgaaagtgctcccgtggcggaggcggcagaagcggcggccttggttgcagagccagagacggtagaggaagaggatatgaatgatagcgcgataaggggcgactcgtttattccccggggcgaagagaagaaggcggaggctgcagcagcagtcgaaacggaagccatggaggaggatatgaatgatagcgctatcaggggtgacacgtttgtgccgcggggcgaagagaagaaagcggaggcggaggccgcagctgaggaggtgaccgaggctgcagctgcggcggtggctgaagcggttgaggaaaaagttcaaaccgagcaggttcagaccgagcaggttcaaaaaaagcctgtgattaaagccctaacacaagatagcaagaagcgcagttataacttgattccaggcagtactgacaccgagtaccgcagctggtacctggcttacaactacggcgacccggttaagggggtgcgctcgtggaccctgctctgcacgccggacgtcacctgcggctccgagcagatgtattggtcgctgccaaacatgatgcaagacccggtgaccttccgctccacgcggcaggttagcaacttcccggtggtaggcgccgaactgctgcccgtgcactccaaaagtttttacaacgagcaggctgtctactcccagctgatccgccaggccacctctctgacccacgtgttcaatcgctttcccgagaaccagattttggcgcgcccgccggcccccaccattaccaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctttccagtcgcactttttaaaacacagacacccacacgctccaaaatcatgtccatactcatctcacccagcaacaataccggctgggggctgcgcgcgcccagcaagatgtttggaggggcaaggaaacgctccgagcagcacccagtgcgcgtgcgcggccactaccgcgcgccctggggagcgcacaagcgcgggcgcacagggcgcaccactgtggacgacgtcattgactccgtagtggagcaggcgcgccactacacacccggcgcgccaaccgcccccgccgtgtccaccgtggaccaggcgatcaatagcgtggtacagggggcgcggcgctatgccaaccttaaaagtcgccgccgccgcgtggcccgccgccatcgccggagaccccgtgccgccgccgccgccgccgcgcgccttgctaaggctctgcttaagcgcgccaggcgaactggccaccgggcggccatgagagccgcacgacgggcggccgccgctgcaagcgccgcgaccccgcggacacgaaggcgcgcggccgccgccgccgccgccgccatttccaacttggcctcaacgcggcgcggtaacatatactgggtgcgcgactcggtaaccggcacacgggtgcccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgacgatgacgaggcggtggagtttgtccgccgcatggcgcccaggcgccccgtgcagtggaagggtcggcgcgtgcagcgcgtcctgcgccccggcaccgcggtggtttttacgcccggcgagcgctccacgcgcactttcaagcgggtgtacgatgaggtgtacggcgacgaggatctgttggagcaggccaaccatcgctttggggagtttgcttatggaaaacggccccgcgagagtctaaaagaggacctgctggcgctgccgctggacgagggcaatcccaccccgagtctaaagccggtgaccctacagcaggtgcttccgctaagcgcgcccagtgagcaaaagcgagggttgaagcgcgagggcggggacctggcacccaccgtgcagctgatggtgcccaagcggcagaagctggaagacgtgctggagaaaatgaaagtagagcccgggatccagcccgaaatcaaagtccgccccattaagcaggtggcgcccggcgttggagtccagaccgtggacgttagaattcccacggaagagatggaaacccaaaccgccactccctcttcggcagcggccaccaccaccaccaccggcgccgcctcggtagaggtgcagacggacccctggctacccgccgccgctgtcgccgccgccccacgttcgcgcgggcgcaagagaaactatccagcggccagcgcgctcatgccccagtatgcgctgcatccatccatcgcacccacccccgggtaccgcgggtactcgtaccgcccgcgcagatcagtcggcacccgcggccgccgccgccgtgcgaccacaaccacccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcaggggcatggcgggcagcggtctccgcggcggccgtcgccatcgccggcgcgcaaagagcaggcgcatgcgcggcggtgtgctgcctctgctaatcccgctactcgccgcggcgattggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcacgcccgttcatgggagactggacagatatcggcaccagcagtatgagcggtggcgccttcagctggggcagtctgtggagcggccttaaaaattttggttccaccattaagaactatggcaacaaagcgtggaacagcagcacgggccagttgctgagagacaagttgaaagagcaaaacttccaggagaaggtggcgcagggcctggcctctggcattagcggggtggtggacatagctaaccaggccgtgcaaaaaaagataaacagtcatctggacccccgcccaccggtggaggaaacgcctccagcgctggagacagtgtcccccgagggcaaaggcgaaaagcgcccgcggcccgacagggaagagaccctggtgtcacacatcgaggagccgccctcttacgaggaggcagtcaaggccggcctgcccaccactcgccccatagctcccatggccaccggtgtggtgggccacaggcaacacactcccgcaacactagatctgcccccaccgtccgagccgccgcgtcagccaaaggcggcgacggtgcccgctccctccacttccgccgccaacagagtgtccctgcgccgcactgcgggcgcccctcggggaccgcgactgagcggcaactggcagagcacactgaacagcatcgtgggcctgggagtaaaaagtgtgaaacgccgccgttgctactgaataagcaagctagctaacgtgttgtatgtgtgtatgcgtcctatgtcgccgccagaggagctgttgagccgctcacgccgtctgcactccagcgaatttcaagatggcgaccccttcgatgatgccacagtggtcgtacatgcacatttcgggccaggacgcttcggagtacctgagccccgggcttgtgcagttcgcccgcgccaccgacacctacttcagcctgagtaacaaattcaggaaccctacggtggcacccacccacgatgtgaccacggaccggtcgcagcgcctgacgctgcggttcatccccgtggatcgggaggacactgcctactcttacaaggcgcgattcacgctggccgtgggcgacaaccgcgtgctggacatggcctccacctactttgacatccggggggtgctggacaggggtcccaccttcaagccctactcgggcactgcctacaactccctggctcccaagggcgctcccaattcttgcgagtgggaagaaaccgaagctgctgaagcagttgttaatgaagatgatgaactggcagagccagaagagcaagcagaagcgacaacaaaaactaacgtgtttgctcaagcgccttactccggccttgagatttctaaagaaggaattaagacaggcatagaagggattggcaatcaaacaaaaccagtatatgcagacaaaacgtatcagccagagcctcagattggagaaactcaatggaatgaaactgaaataaataatggcgcaggaagggtgctaaagaagaccactcctatgaaaccttgctatggttcttatgctaaacctactaatgaatatggaggacagggtattcttgaagaaaaaaatggcaaaatggaaagtcaggtggaaatgcagttttttgctccaagcaatgacgaagacgaaaacgaaccaaaagttgttttgtatagtgaagatgtatacatggagacccctgacactcacctatcatacaaacctagcgcccaagatgtaaactccaaagaaatgttgggtcaacaggccatgcccaacaggcccaaccttattgcttttagagacaactttattggactcatgtactacaacagcactggcaacatgggagtgttggctggacaggcctctcagctaaatgctgtggtagacttgcaagacaggaacacagaactgtcataccagctgatgcttgactccattggagacagatcaagatatttttccatgtggaaccaggcggtggatagctatgatccagatgttagaattattgaaaaccacggcacagaggatgaacttccaaactactgttttcccttgggaggaatatttaatactcagagttttaaaaaggtaaatcccaatggggcagatggggaatggcaaaaagatgacactttcgcagaaaagaatgaaataagagttggcaacaactttgccatggagattaatatccaggcaaacctgtggagaagctttttgtattccaatgtggctctctacctgccagataaaatgaagtactctcccaccaacatagacatttccaccaacactaacacttatgactacatgaacaaaagagtggtgcctccaggcctggtggactgctatgttaatctgggggccaggtggtccctggatgtgatggataacatgaacccctttaaccaccaccgcaatgcgggcctgcgataccgttccatgcttctgggtaacgggcgctacgtgcccttccacatccaggtgccccaaaagttctttgccatcaaaagccttctactcttgcctggctcgtacacatacgaatggaatttcagaaaggatgtgaacatggtcctacagagctctctgggcaacgaccttagggtggatggggccagcatcaaatttgacagcattgccctctatgctacctttttccccatggcccacaacaccgcctccacgctcgaggccatgcttagaaacgacaccaacgaccagtccttcaatgactacctctctggggccaacatgctctaccccatccccgccaacgccaccaacgtgcccatctccatcccctctcgcaattgggctgccttcagaggctgggcatttacccgccttaagaccaaagagaccccctccctgggctcgggttttgatccctactttgtctactcgggatccatcccctacctggatggcaccttctaccttaaccacactttcaagaagatatccatcatgtatgactcctccgtcagctggccgggcaacgaccgcctgctcacccccaatgaattcgaggttaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtagacgagaccaaatacaaggactatcaggccattggcatcacccaccagcacaacaactcgggtttcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttctctagcaactttatgtccatgggtgcgctcacggacctgggccaaaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcggccggcaacgccaccacctaaggagacagcgccgccgcctgcatgacgggttccaccgagcaagagctcagggccatcgccagagacctgggatgcggaccctattttttgggcacctttgacaaacgcttcccgggctttatctcccgagacaagctcgcctgcgccatagtcaacacggccgcgcgcgagaccgggggcgtgcactggctggcctttggctgggatccgcgctccaaaacttgctacctctttgacccctttggattctctgatcagcgtctcaggcagatctatgagtttgagtacgaggggctgctgcgccgcagtgcgctcgcctcctcgcccgaccgctgcatcacccttgagaagtccaccgagaccgtacaggggccccactcggccgcctgcggtctcttctgctgcatgtttctgcacgccttcgtgcgctggccccagagtcccatggatcgcaaccctaccatgaacttgctaaagggagtgcccaacgccatgctccagagcccccaggtccagcccaccctgcgccgcaaccaggaacagctctaccgcttcctggagcgccactccccctattttcgcagccacagcgcgcgtatccgggggaccacctctttctgccacttgcaagagaacatgcaagacggaaaatgatgtacagcatgcttttaataaatgtaaagactgtgcactttatttatacacgggctctttctggttatttattcaacaccgccatttagaaatcgaaagggttctgccgcgcgtcgccgtgcgccacgggcagagacacgttgcgatattggaaccggctcgtccacttgaactcgggcaccaccatgcggggcagtggttcctcggggaaattctcgccccacagggtgcgggtcagctgcagcgcgctcagaaggtcgggagccgagatcttgaagtcgcagttgggtccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcaaacctgcctgcccaggaaaggcgggagcccgggcttgccgttgcagtcgcagcgcaggggcatcagcaggtgcccgcggcccgactgcgcctgcgggtacaacgcgcgcatgaaggcttcgatctgcctgaaagccacctgggtcttggctccctccgaaaaaaacatcccacaggacttgctggagaactggttcgcgggacagctggcatcgtgcagacagcagcgcgcgtcggtgttggcgatctgcaccacgttgcgaccccaccggttcttcactatcttggccttggaagcctgctcctttagcgcgcgctggccgttctcgctggtcacatccatttcgatcacctgttccttgttaatcatgtttgtcccgtgcagacacttcaagtcgccctccgtctgggtacagcggtgctcccacagcgcgcaacccgtgggctcccaattcttgtgggtcacccccgcgtaggcctgcaggtaggcctgcaggaagcgccccatcatggttataaaggtcttctggctcgtaaaggtcagctgcaggccgcgatgctcttcgttcagccaggtcttgcagatggcggccagcgcatcggtctgctcgggcagcatcttaaaacttgtcttcaggtcgttatccacgtggtacttgtccatcatggcacgcgccgcctccatgcccttctcccaggcggacaccatgggcaggcttagggggtttatcacttccaccggcgaggacaccgtactttcgatttcttcttcctccccctcttcccggcgcgcgcccacgctgctacgcgctttcaccgcctgcaccaaggggtcgttttcaggcaagcgccgcaccaagcgcttgccacccttgacctgcttaatcagcaccggcgggttgctgaagcccaccatggtcagcgccgcctgctcttcttcgtcttcgctgtctaccactatctccggggaagggcttctccgctctgcggcggcgcgcttcttttttttcttgggagcagccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctctgaaaccgccgtcgccgtcgcccccgctgccgccgacgcgcccgccacaccgagcgacacccccgccgacgcacccctgttcgaggaagcggccgtggaacaggacccgggctttgtctcggcagaggaggatttgcaagaggaggaggataaggaggagaagccctcagtgccaaaagatgataaagagcaagacgagcacgacgcagacgcacaccagggtgaagtcgggcggggggacgaagggcatggcggcgccgactacctagacaaaggaaacgacgtgctcttgaagcacctgcatcgccagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtaccaaagatcttcgagggtctgggtcgcaacgaaaagcgggcagcaaactctctgcaacaggaaaacagcgaaaatgagagtcacaccggggtgctggtggagctcgagggcgacaacgcccgcctggcggtgctcaagcgcagcatcgaggtcacccactttgcctaccccgcgctcaacctgccccccaaagtcatgaacgcagtcatggacgggctgatcatgcgccgcggccagccccttgctccagatgcaaacttgcatgaggagaccgaggacggccagcccgtggtcagcgacgagcagctggcgcgctggctggaaaccgcggaccccgccgaactggaggagcggcgcaagatgatgatggccgcagtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgagaaccgccttgggcagagcgtgctgcactccaccctgcgcggggaagcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaaaacctctggacgggctacaacgagcgctcggtggccgccgcgctggccgacctcatcttccccgagcgcctgctcaaaactctccagcaggggctgcccgacttcaccagccaaagcatgttgcaaaacttcagaaactttatcctggagcgttctggcatcctacccgccacctgctgcgccctgcccagcgactttgttcccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccggcggcagcggcgcccgtttcggtgcctaggaagacccagggcaagacttcagccaagaaactcgcggcggccgcggcgaacgcggtcgcgggggccctgcggctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtggagcaggcggcaattaccaccacgccccgcaataatcccaaccccagggagtggcccgcgtccctggtgtatcaggaaattcccggccccaccactgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactcttcagttcgtgcaggagtttgtgccctcggtctacttcaaccccttctcgggctctcccggtcgctacccggaccagttcatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatctgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaaaaacaacaccctcgagctacttcctccttacctgcccgggacttaccagtgtgtcaccggtccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataaaacatgctactgctcaccttccttatcctggcgctaaccgcccaatgccaagccttttccgaggctgactttgtagagccccagtgcaacgttacttttaaagcctatgcacagcgttgtcatactataatcaaatgtgccaccgaacacaatggataccttattcagtataaagataaatcacacaaagtggcacttgttgacatctgggaaccagaagaccctctggaatacaatgttaccgttttccagggtgacctcttcagaacttacaattacactttcccatttgaccagatgtgtgactttgtcatgtacatggaaaagcagcacaagctgtggcctccaactccccagggctgtgtggaaaatccaggctctttctgtatgatctctctctgtgtaactgtgctggcactaatactcacgcttctgtatctcagatttaaatcaaggcaaagctttattgatgaaaagaaaatgccataatcgctttcacgcttaattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatttaaccttgattgatgttcaattgctggatgcgggctactattatgggcagctgggtacaatgattaattactggagaccccacagagattacatgcttcacgtagtaaagggtcccattagcagcccaaccaccacctctaccacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgtccaggatttggaagatcacgaggaagatgagcatgactacgcagatgcatgccaggcatcagaggcagaagcgctaccggtggccctaaaacagtatgcagactcccacaccacccccgaccttcctccaccttcccaaaagccaagtttcctgggggaaaatgaaactttgcctctctccatactcgctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacggcctatggacttacaacattgtctcttaatgagaccaccgctcctcaatacctgtacgatggtgtctccgcgctggttaaccagtgggatcgcctgggcatatggtggctccttataggagcagtgaccctgtgcctaatcctggtctggatcatctgctgcatcaaaagcagaaaacccaggcggcggcccatctacaggccctttgtcatcacacctgaagatgatgatgacaccacctccaagctgcagaggctaaagcagctactcttctcttttacagcatggtaaattgaatcatgccccgcattttcatctacttgtctctccttccactttttctgggctcctctacattggccgctgtgtcccacatcgaggtagactgcctcacacccttcacagtctacctgcttttcggctttgtcatctgcacctttgtctgcagcgttattactgtagtgatctgcttcatacagtgcatcgactacatctgcgtgcgggtggcctactttagacaccacccccagtatcgcaacagggacatagcggctctcctaagacttgtttaaaattatggccaaattaactgtgattggtcttctgatcatctgctgcgtcctagccgcgattgggactactcaacctaataccaccaccagcgctcccagaaagagacatgtatcctgcagcttcaagcgtccctggaatataccccaatgctttactgatgaacctgaaatctctttggcttggtacttcagcgtcaccggccttctcatcttctgcagtacggttattgcccttgccatttatccttcccttaacctgggctggaatgctgtcaactctatggaatatcccaccttcccagaaccagacctgccagacctggttgttctaaacgcgtttcctcctcctcctccagttcaaaatcagtttcgccctccgtccccgacgcccactgaggtcagctactttaatctaacaggcggagatgactgaaaacctagacctagaaatggacggcctctgcagcgagcaacgcacactagagaggcgccggcaaaaagcagagctcgagcgtcttaaacaagagctccaagacgcggtggccatacaccagtgcaaaaaagggctcttctgtctggtaaaacaggccacgctcacctatgaaaaaacaggtgacacccaccgcctaggatacaagctgcccacacagcgccagaagttcgcccttatgataggtgaacaacccatcaccgtcacccagcactccgtggagacagaaggctgcatacatgctccctgcaggggcgctgactgcctctacaccttgatcaaaaccctctgcggtctcagagaccttatcccttttaattgatcataactgtaatcaataaaaaatcacttacttgaaatctgatagcaagcctttgtccaattttttcagcaacacttccttcccctcttcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcaaactgcctccccccttgccgtcagctcgggagccctcacacttttcgctactcctcccctggcagttaatgacaataacctgactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactaagcattagcagtgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggtatgagacttaacaatggcacacttatactagatgtaaactacccatttgaggctcaaggtcaacttagcctaagagtgggttcgggtccgctgtatgtagactccaacacacacaacctaaccgctagatgccttagagggctatacataacgtcatctaataaccaaaccggcctggaggccaacataaaacttacaaaaggacttgtgtttgatggaaatgccatagcagttaatgtcagcaaagggctagaatacagtaccactgaaacagcgcagggtgtaaatccaatacagactaaaataggtttgggcatggaatatgataccgatggagccataaaaccaagactaggctctggtttgagctttgataattcaggagctattgtagtgggaaacaaatatgatgacactcttactctgtggactacaccagacccatctcccaactgtcaaattaactccgaaaaagatgctaaactaaccttggtactaaccaagtgcggtagtcaaattgtaggcacagtatctgcccttgctcttaaaggcagccttgccccaattaatggcacagtgagctcagttagcatattcctaagatttaatgaaaatggggtgctgatgagcaactcatcgttggaaagccaatactggaattacagaaatggaaattcaactaatgccacaccatatacaaacgcactaggttttatgcctaacctagcggcttatcccaaaggccaggctacaactgcaaaaagcagcatcattagccaggtttacatgaatggcgacacttcaaaacctatgacatttacaataacttttaatggccttagtgaatcagaggaatctcaggtcagtacatattccatgacattttcatggaggtggacaaatggagactacgtggggcactattttataacaaactcctttactttctcctacatcgcccaagaataaagaaagcacagagatgcttgtttttgatttcaaaattgtgtgcttttatttattttcaagcttacagtatttccagtagtcattcgaatagagcttaatgaaactgcatgagaacccttccacatagcttaaattatcaccagtgcaaatggagaaaaatcaacatacctttttatccagatatcatagaactctagtggtcagttttcccccaccatcccaactcacagaatacacagtcctttccccccggctggctttaaacaacactatctcattggtaacagacatattcttaggtgtaataatccacacggtctcttggcgggccaaacgctggtcagtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgctgcaacaaggcgcgcagcaactcctgccgccgcctctccgtacgacaggaatgcaacggggtggtggtctcctccgcgataatccgcaccgctcgcagcatcagcgtcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcataccagatcctcaggtaaatcaaatgacgacctctcatgaacacgctggacatgtacatcacctccttgggcatgtgctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagaatcatgccaaagggaacagcggacgtactcatatttcctccagcagaaccaagtgcgcgcgtggcagctatccttgcgtcttctgtctcgccgcctgccccgctcggtgtagtagttgtaatacagccactccctcagaccgtcaaggcgctccctggcgtccggatctataacaacaccatcctgcagcgccgccctgatgacatccaccaccgtagagtatgccaagcccagccaggaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacataactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaataataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcgaaaatagcaaactacatttcccacatgtacaaaaccaaaacccctccccttgtcaccgcccacaacttacataatcacaaacgtcaaagcctacgtcacccgccccacctcgccccgcccacctcattatcatattggccacaatccaaaataaggtatattattgatgatg

SEQ ID NO: 143 - protein, 828 aa, Ape adenovirus AH16
MQVEKEESLTTPSETAVAVAPAAADAPATPSDTPADAPLFEEAAVEQDPGFVSAEEDLQEEEDKEEKPSVPKDDKEQDEHDADAHQGEVGRGDEGHGGADYLDKGNDVLLKHLHRQCAIVCDALQERSEVPLSVAEVSRAYELSLFSPRVPPRRRENGTCEPNPRLNFYPAFVVPEVLATYHIFFQNCKIPISCRANRSRADKMLALRQGDHIPDIAALEDVPKIFEGLGRNEKRAANSLQQENSENESHTGVLVELEGDNARLAVLKRSIEVTHFAYPALNLPPKVMNAVMDGLIMRRGQPLAPDANLHEETEDGQPVVSDEQLARWLETADPAELEERRKMMMAAVLVTVELECLQRFFGDPEMQRKVEETLHYTFRQGYVRQACKISNVELSNLVSYLGILHENRLGQSVLHSTLRGEARRDYVRDCVYLFLCYTWQTAMGVWQQCLEERNLKELEKLLQRALKNLWTGYNERSVAAALADLIFPERLLKTLQQGLPDFTSQSMLQNFRNFILERSGILPATCCALPSDFVPLVYRECPPPLWGHCYLFQLANYLSYHADLMEDSSGEGLMECHCRCNLCTPHRSLVCNTQLLSESQIIGTFELQGPSSSDEKSAAPGLKLTPGLWTSAYLRKFVPEDYHAHEIRFYEDQSRPPKAELTACVITQGEILGQLQAIQKARQEFLLKRGRGVYLDPQSGEELNPVPPLPPPRDLASQDKHRHGSQKEAAAAAAAAAPHAGGRGGILGQSGRGGFGRGGAGDGDGRVGGGQLRRGGFRSRRGRRNTVTLGRSPLAGAPEVRSQHQQQQQRYNLRSSTAATHGRPQTQP

SEQ ID NO: 144 - protein, 149 aa, Ape adenovirus AH16
MRADREELDLPPPVGGLAVDVVKVEVPSAGRALVLAFVKATAVLAALHGLYILHEVNLATSDEEAQRESKSPAWGPVWLVVFYFGCLAASICLLEGDGGTDHHAARAAGPDLGARRAEFDDDIAHIGAVHGLQLPRRQVSREFLEVYLA

SEQ ID NO: 145 - protein, 199 aa, Ape adenovirus AH16
MAPRKKQQRPPLPPPHMLEEEEEYWDSQAEEVSDEEEPETEMEEWEEDSLDEEASEAEEAGATPSPSAAAPSQAPPKSAPSISSNSSAITSAPPPPRPTADRRPNRRWDTTGTGAGKSSGRGKQAQRQGYRSWRAHKNAIVACLQDCGGNISFARRFLLFHHGVAFPRNVLHYYRHLYSPYCGGSEPEAAGGSGARFGA

SEQ ID NO: 146 - protein, 275 aa, Ape adenovirus AH16
MAPRKKQQRPPLPPPHMLEEEEEYWDSQAEEVSDEEEPETEMEEWEEDSLDEEASEAEEAGATPSPSAAAPSQAPPKSAPSISSNSSAITSAPPPPRPTADRRPNRRWDTTGTSLACKTAGGTSPSPAASCSSTTVWPSPVTSCITTVISTAPTAAAVSQRRPAAAAPVSVPRKTQGKTSAKKLAAAAANAVAGALRLTVNEPLSTRELRNRIFPTLYAIFQQSRGQDQELKVKNRSLRSLTRSCLYHKSEDQLRRTLEDAEALFSKYCALTLKD

SEQ ID NO: 147 - protein, 408 aa, Ape adenovirus AH16
MHPVLRQMRPSPRPDQQQQQQACRPPSPLPAPVTTAAAAVSGAGGALESDEPPRRRPRQYLDLEEGEGLARLGASSPERHPRVQLKRDAREAYLPRQNLFRDRGGEEPEEMRDCRFQAGRELRRGLDRQRLLREEDFEPDMQTGISPARAHVAAADLVTAYEQTVNQERNFQKSFNNHVRTLVAREEVTLGLMHLWDLVEAIVQNPSSKPLTAQLFLVVQHSRDNEAFREALLNITEPEGRWLLDLINILQSIVVQERSLSLAEKVAAINYSMLSLGKFYARKIYKTPYVPIDKEVKIDSFYMRMALKVLTLSDDLGVYRNERIHKAVSASRRRELSDRELMHSLQRALTGAGEGDREVESYFDMGADLHWQPSRRALEAAGAYGGPLAANDEEEEDYELEEGEYLED

SEQ ID NO: 148 - protein, 543 aa, Ape adenovirus AH16
MASRDQDQREKTPERGRGSARRPPPVEGVPSPSPSPPPLTRAPPKKRLRRRLESEEESEGDEALVPRTPSPTPSTSVAVADSITAAPKKKKKRAAAERRSPSPEIVVDSEDEEEQAALTMVGFSNPPVLIKQVKGGKRLVRRLPENDPLVQAVKARSSVGARREEGEEEEIESTVSSPVEVINPLSLPMVSAWEKGMEAARAMMDKYHVDNDLKTSFKMLPEQTDALAAICKTWLNEEHRGLQLTFTSQKTFITMMGRFLQAYLQAYAGVTHKNWEPTGCALWEHRCTQTEGDLKCLHGTNMINKEQVIEMDVTSENGQRALKEQASKAKIVKNRWGRNVVQIANTDARCCLHDASCPANQFSSKSCGMFFSEGAKTQVAFRQIEAFMRALYPQAQSGRGHLLMPLRCDCNGKPGLPPFLGRQVCKMTPFALSNAEDLDSDMISDESLLASVNNPALLVFQCCNPVYRNSRAQGSGPNCDFKISAPDLLSALQLTRTLWGENFPEEPLPRMVVPEFKWTSRFQYRNVSLPVAHGDARQNPFDF

SEQ ID NO: 149 - protein, 184 aa, Ape adenovirus AH16
MEAWGCLEEFADVRRLLDESSSNTYSIWRYLWGSTQAKLVSRIKQDYKCDFEELFSSCGELLQSLNLGHQAIFQEKVLSTLDFSTPGRTAACVAFVSFVQDKWSGETHLSHGYVLDFMAMALWRAYNKWKIQKELYGSALRRPLLQRQGLMFPDHRQHQNLEDESEERAEKISLRAGLDPPQEE

SEQ ID NO: 150 - protein, 503 aa, Ape adenovirus AH16
MERGDPPESRLRAGFHGDGSLEGLQQMEDSEGTVRFRPTSSTSAAAGADVSRPSPASESGRRVGGASGEDQLESRPGPSSGGMNLPQVVELFPELRRVLTIREDGQFVKKLKRDRGEGDDEAASNLAFSLITRHRPECITYQQIKESCANELDLLGQKYSIEQLTTYWLQPGDDWEEAIRVYAKVALRPDCKYKITKLVNIRNCCYISGNGAEVEIDTEDRVAIRCCMINMWPGILGMDGVIFMNVRFTGPNFNGTVFMGNTNLLLHGASFYGFNNTCIEAWTDVKVRGCSFYSCWKAVVCHPKSRGSVKKCLFERCTLGILSEGNSRVRHNVASNCGCFMQVKGVSVIKHNSVCGNCEDRASQMLTCFDGNCHLLKTIHISSHPRKAWPVFEHNILTRCSLHLGVRRGMFLPYQCNFSHTKILLEPECMTKVSLNGVFDVSLKIWKVLRYDETRTRCRPCECGGKHMRNQPVMLDVTEELRPDHLVLACTRAEFGSSDEDTD

SEQ ID NO: 151 - protein, 107 aa, Ape adenovirus AH16
MSGGPGAEQLRLKHLDHCRRPQCFARCQTGEFQYFSLPDSHPDGPAHGVRFFIPSQVRSTLIREFTARPLLAELEKGPSILTIACICSNPGLHQDLCCHLCAEYNKG

SEQ ID NO: 152 - protein, 128 aa, Ape adenovirus AH16
MTENLDLEMDGLCSEQRTLERRRQKAELERLKQELQDAVAIHQCKKGLFCLVKQATLTYEKTGDTHRLGYKLPTQRQKFALMIGEQPITVTQHSVETEGCIHAPCRGADCLYTLIKTLCGLRDLIPFN

SEQ ID NO: 153 - protein, 161 aa, Ape adenovirus AH16
MLLLTFLILALTAQCQAFSEADFVEPQCNVTFKAYAQRCHTIIKCATEHNGYLIQYKDKSHKVALVDIWEPEDPLEYNVTVFQGDLFRTYNYTFPFDQMCDFVMYMEKQHKLWPPTPQGCVENPGSFCMISLCVTVLALILTLLYLRFKSRQSFIDEKKMP

SEQ ID NO: 154 - protein, 68 aa, Ape adenovirus AH16
MNNSTSANGTLPNESGLNIGNQVAVSLLITFIVLFLLVLSLLCLRIGGCCIHVYIWCWLFRRFGDHRR

SEQ ID NO: 155 - protein, 90 aa, Ape adenovirus AH16
MPRIFIYLSLLPLFLGSSTLAAVSHIEVDCLTPFTVYLLFGFVICTFVCSVITVVICFIQCIDYICVRVAYFRHHPQYRNRDIAALLRLV

SEQ ID NO: 156 - protein, 142 aa, Ape adenovirus AH16
MAKLTVIGLLIICCVLAAIGTTQPNTTTSAPRKRHVSCSFKRPWNIPQCFTDEPEISLAWYFSVTGLLIFCSTVIALAIYPSLNLGWNAVNSMEYPTFPEPDLPDLVVLNAFPPPPPVQNQFRPPSPTPTEVSYFNLTGGDD

SEQ ID NO: 157 - protein, 294 aa, Ape adenovirus AH16
MSTSAVPFGMILRSTRSRLSRHCPYTRDRLPPFETETRASVMEDHPVFPDCDTLTMHNVSYVRGLPCCVGFTLIQEWVIPWDMVLTREELLIMKKCMKVCLCCANVDIMTSSMVHGYERWSLHCHCDSPGSLQCLAGGQVLASWFRMVLEGSLINQRCLWYREVVNQHMPKEVMYMSSVFMRGRHLIYLRIWYDGHVGAVLPAMSFGYSALHCGILNNILVLCCTYCADLSEIRMRCCARRTRTLMLRAVRIIAEETTTPLHSCRTERRRQELLRALLQHHRPILMGDYDSTPL

SEQ ID NO: 158 - protein, 127 aa, Ape adenovirus AH16
MAAVEALYVVLEGEGAILPTQEGVSGVYRFYSPTNFVIPPHGVILLYLRLSVIIPPGYIGRFLCLADVSNPGVYTGSHVMTPDMTGQLSVLLFNHTDNFFYGHAGDVVARLMLVRVVYPIVRQATLV

SEQ ID NO: 159 - protein, 117 aa, Ape adenovirus AH16
MMRMLKMKVEGGLAQLFELVGGDLKEELVNIFSRWRDENYMGLVDSCGVFIIDHDRGGGFDVMLAVDFRGDFMLQALVQHLTNRVVCGLAVIFDRLSGGDQCHLIDLHFDIVEDRLE

SEQ ID NO: 160 - protein, 121 aa, Ape adenovirus AH16
MVLPSLPAPPISRCQSECISWLGLAYSTVVDVIRAALQDGVVIDPDARERLDGLREWLYYNYYTERGRRRDRRRKDSCHARTWFCWRKYEYVRCSLWHDSTFNTISIIPPLSLHEGPFTSL

SEQ ID NO: 161 - protein, 130 aa, Ape adenovirus AH16
MFERKIVHFSVVVPELTCIYLHEHGYDVLAFLRECLPDFLTQTVHFLSPPMQYAYLGAVLVSIAPNMRIIISIGSVELVPGGEMSSLIRSDLWDYIMLALRRDLRERNIDVNVPLLNLIQVSEEPEFLQS

SEQ ID NO: 162 - protein, 581 aa, Ape adenovirus AH16
MKRARSSDETFNPVYPYDTEIAPTSVPFPTPPFVSPAGMQENPPGVLSLRLAEPLTTSNGALTLKMGGGLTLDEEGKLTSQNITSVDPPLKKTKNNISLQTASPLAVSSGALTLFATPPLAVNDNNLTVQSQAPLTLENSKLSLATKGPLTVSEGKLALETEAPLHASDSSSLGLSVTAPLSISSDSLGLDLQAPIISENGKLGLRVTGPLTVASSIDALTVATGSGIGLDSNTRLQAKLVAPLGFDTNGNIKLSTSGGMRLNNGTLILDVNYPFEAQGQLSLRVGSGPLYVDSNTHNLTARCLRGLYITSSNNQTGLEANIKLTKGLVFDGNAIAVNVSKGLEYSTTETAQGVNPIQTKIGLGMEYDTDGAIKPRLGSGLSFDNSGAIVVGNKYDDTLTLWTTPDPSPNCQINSEKDAKLTLVLTKCGSQIVGTVSALALKGSLAPINGTVSSVSIFLRFNENGVLMSNSSLESQYWNYRNGNSTNATPYTNALGFMPNLAAYPKGQATTAKSSIISQVYMNGDTSKPMTFTITFNGLSESEESQVSTYSMTFSWRWTNGDYVGHYFITNSFTFSYIAQE

SEQ ID NO: 163 - protein, 947 aa, Ape adenovirus AH16
MATPSMMPQWSYMHISGQDASEYLSPGLVQFARATDTYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEETEAAEAVVNEDDELAEPEEQAEATTKTNVFAQAPYSGLEISKEGIKTGIEGIGNQTKPVYADKTYQPEPQIGETQWNETEINNGAGRVLKKTTPMKPCYGSYAKPTNEYGGQGILEEKNGKMESQVEMQFFAPSNDEDENEPKVVLYSEDVYMETPDTHLSYKPSAQDVNSKEMLGQQAMPNRPNLIAFRDNFIGLMYYNSTGNMGVLAGQASQLNAVVDLQDRNTELSYQLMLDSIGDRSRYFSMWNQAVDSYDPDVRIIENHGTEDELPNYCFPLGGIFNTQSFKKVNPNGADGEWQKDDTFAEKNEIRVGNNFAMEINIQANLWRSFLYSNVALYLPDKMKYSPTNIDISTNTNTYDYMNKRVVPPGLVDCYVNLGARWSLDVMDNMNPFNHHRNAGLRYRSMLLGNGRYVPFHIQVPQKFFAIKSLLLLPGSYTYEWNFRKDVNMVLQSSLGNDLRVDGASIKFDSIALYATFFPMAHNTASTLEAMLRNDTNDQSFNDYLSGANMLYPIPANATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETKYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 164 - protein, 450 aa, Ape adenovirus AH16
MRDGRAGRRAAAIQHQQNQPQAHPGQRPTRSAPLHRYADHPDEDPAPMEGHDSGPAGRPSAGALQRKPPQPAKRGDLLDRDAVEHITELWDRLELLTQTLKNMPTADGLKPLKNFASLQELLSLGGERLLAELVRENIHVRDMLNEVAPLLREDGSCSSLNYQLQPVIGVIYGPTGCGKSQLLRNLLSSQLISPAPETVFFIAPQVDMIPPSEMKAWEMQICEGNYAPGPEGTIIPQSGTLRPQFVKMSYDDLTLEHNYDVSDARNVFAQAASHGPIAIIMDECMENLGGHKGVSKFFHAFPSKLHDKFPKCTGYTVLVVLHNMNPRRDLGGNIANLKIQSKMHIISPRMHPSQLSRFVNTYTKGLPLAISLLLKDIFQHHAQRSCYDWIIYNTTPEHEALQWCYLHPRDGLMPMYLNIQSHLYHVLERIHRTLNDRDRWSRAYRARRVK

SEQ ID NO: 165 - protein, 133 aa, Ape adenovirus AH16
MSDTGNSFDGSIFSPYLTVRMPHWAGVRQNVMGSNVDGRPVLPSNSSTMAYATVGGTPLDAATSAAASAAAATARSMATDLYSSLVASSAASRASARDEKLTALLLKLEDLTRELGQLTQQVSSLRESSLASP

SEQ ID NO: 166 - protein, 621 aa, Ape adenovirus AH16
MRRAAMFEEGPPPSYESAMGISPAAPLQPPYVPPRYLQPTGGRNSICYSELQPLYDTTKVYLVDNKSADVASLNYQNDHSDFLTTVIQNNDFSPNEASTQTINLDNRSNWGGDLKTILHTNMPNVNEFMFTNSFKARVMVARDDKGVPKYEWVDFTLPEGNYSETMTLDLMNNAIVEHYLKVGRQNGVKESDIGVKFDTRNFRLGWDPETGLIMPGVYTNEAFHPDIVLLPGCGVDFTQSRLSNLLGVRKRQPFQEGFKITYEDLEGGNIPALLDLDAYEESLKSEESGGGAVEGGEEQAGDSGTASVENESAPVAEAAEAAALVAEPETVEEEDMNDSAIRGDSFIPRGEEKKAEAAAAVETEAMEEDMNDSAIRGDTFVPRGEEKKAEAEAAAEEVTEAAAAAVAEAVEEKVQTEQVQTEQVQKKPVIKALTQDSKKRSYNLIPGSTDTEYRSWYLAYNYGDPVKGVRSWTLLCTPDVTCGSEQMYWSLPNMMQDPVTFRSTRQVSNFPVVGAELLPVHSKSFYNEQAVYSQLIRQATSLTHVFNRFPENQILARPPAPTITTVSENVPALTDHGTLPLRNSISGVQRVTITDARRRTCPYVYKALGIVSPRVLSSRTF

SEQ ID NO: 167 - protein, 595 aa, Ape adenovirus AH16
MQDPNVADPAVRAALQSQPSGINSSDDWAAAMGRIMALTARNPEAFRQQPQANRLAAILEAVVPARSNPTHEKVLAIVNALAESRAIRADEAGLVYDALLQRVARYNSGNVQTNLDRLVTDVREAVAQRERLHQDGNLGSLVALNAFLSTQPANVPRGQEDYTNFLSALRLMVTEVPQSEVYQSGPDYFFQTSRQGLQTVNLSQAFKNLRGLWGVKAPTGDRATVSSLLTPNSRLLLLLIAPFTDSGSVSRETYLGHLLTLYREAIGQAQVDEHTFQEITSVSHALGQEDTGSLQATLNYLLTNRRQKIPTLHSLTQEEERILRYVQQSVSLNLMRDGVTPSVALDMTARNMEPGMYASHRPFINRLMDYLHRAAAVNPEYFTNAILNPHWMPPPGFYNGDFEVPEVNDGFLWDDMDDSVFSPNPLRAASLRLKEGSDREGPRSLASSLALGAVGATGAAARGSSPFPSLADSLNSGRVSRPRLLGEEEYLNNSLLQPARDKNAQRQQFPNNGIESLVDKMSRWKTYAQEYKEWEDRQPRPLPPPRQRWQRRASNRRWRQGPEDDDDSADDSSVLDLGGSGNPFSHLRPRLGKMF

SEQ ID NO: 168 - protein, 1060 aa, Ape adenovirus AH16
MALVMDSSNVRDVVIKLRPPSAEIWTCGSRGVVVCSTIALQETDAGGQTTKVKDHQPHGTPGGGLRFPLRFLVRGRQVHLVQDIQPVQRCQYCGRFYKSQHECSARRRDFYFHHINSQSSNWWREIQFFPIGSHPRTERLFVTYDVETYTWMGAFGKQLVPFMLVMKLGGDEALVAAARDLARELRWDPWEKDPLTFYCITPEKMAVGRQFRTFRDRLQTLMARDLWRSFLAANPHLQDWALEEHGLESPEELTYEELKKLPSIKGQPRFLELYIVGHNINGFDEIVLAAQVINNRSSVPGPFRITRNFMPRAGKILFNDLTFSLPNPRSKKRTDYTLWEQGGCDDTDFRHQYLKVMVRDTFALTHTSLRKAAQAYALPVEKGCCPYQAVNQFYMLGSYRSDTDGFPLQEYWKDREEFVLNRELWKKKGEDKYDIIRETLDYCALDVQVTAELVHKLRESYASFVRDSVGLQEASFNVFQRPTISSNSHAIFRQIVFRAERPQRTNLGPNMLAPSHELYDYVRASIRGGRCYPTYLGILREPLYVYDICGMYASALTHPMPWGPPLNPYERALAAREWQRALDMQACKIDYFDPRLLPGVFTIDADPPNEDQLDTLPPFCSRKGGRLCWTNERLRGEVATSVDMVTLHNRGWRVRLIPDERTTVFPEWKCVAREYVQLNIAAKERADRDKNQTLRSIAKLLSNALYGSFATKLDNKKIVFSDQMDPGTLKGITSGQVNIKSSSFLETDNLSAEVMPAFEREYLPQQLALADSDAEESEDERAPTPFYTPPSGTPGHVSYTYKPITFLDAEEGDMCLHTLEKVDPLVDNDRYPSHVASFVLAWTRAFVSEWSEFLYEEDRGTPLEDRPLKSVYGDTDSLFVTEKGHRLMESRGKKRIKKHGGNLVFDPDRPELTWLVECETVCAACGADAYSPESVFLAPKLYALKSLQCPSCGATSKGKLRAKGHAAEGLDYETMVKCYLADAQGEERQRFSTSRTSLKRTLASAQPGAHPFTVTQTTLTRTLRPWKDMTLAPLDAHRLVPYSESRPNPRNEEICWIEMP

SEQ ID NO: 169 - protein, 210 aa, Ape adenovirus AH16
MTGSTEQELRAIARDLGCGPYFLGTFDKRFPGFISRDKLACAIVNTAARETGGVHWLAFGWDPRSKTCYLFDPFGFSDQRLRQIYEFEYEGLLRRSALASSPDRCITLEKSTETVQGPHSAACGLFCCMFLHAFVRWPQSPMDRNPTMNLLKGVPNAMLQSPQVQPTLRRNQEQLYRFLERHSPYFRSHSARIRGTTSFCHLQENMQDGK

SEQ ID NO: 170 - protein, 639 aa, Ape adenovirus AH16
MALMEHFSPLRNIWNRVRDYARATTTAAGITWMSRYIYGYHRLMLEDLAPGAPATQRWPLYRQPPPHFLVGYQYLVRTCNDYVFDSRAFSRLRYTELSQPGHQTVNWSVMANCTYTINTGAYHRFVDMDDFERTLTQVQQAILAERVVADLALLQPLRGFGVTRMGGARNHRRDGEEEGEEVPVERLMQDYYKDLRRCQNEAWGMADRLRIQQAGPKDMVLLSTIRLLKTAYFNYIISSISARNSPDPPPPATVLSLPCDCDWIDAFLQRFSDPVDLDSIRSLGGVPTQQLLRCIVSAVSLPHGRPPRGEMRGGVFELRPRENGRAVTETMRRMRGEMIERFIDRLPVRRRRRRAPPPPPPPPVPAEEEEEAIMEEEVEEEEAPPVAFEREVRDTVAELIRLLEEELTVSARNSQFFNFAVDFYEAMERLEALGDINESTLRRWVMYFFVTEHTATTLNYLFQRLRNYAVFTRHVELNLAQVVMRARDAEGGVVYSRVWNEGGLNAFSQLMGRISNDLAATVERAGRGDLQEEEIEQFMAEIAYQDNSGDVQEILRQAAVNDAEIDSVELSFRFKVTGPVVFTQRRQIQDTNRRVVAHASALRSQHQPLPARGEDVPLPPMPVGPEPPLPPGARPRHRF

SEQ ID NO: 171 - protein, 359 aa, Ape adenovirus AH16
MSKRKIKEEMLQVIAPEIYGPPKKEEEDYKPRKLKRVKKKKKDDDDEAVEFVRRMAPRRPVQWKGRRVQRVLRPGTAVVFTPGERSTRTFKRVYDEVYGDEDLLEQANHRFGEFAYGKRPRESLKEDLLALPLDEGNPTPSLKPVTLQQVLPLSAPSEQKRGLKREGGDLAPTVQLMVPKRQKLEDVLEKMKVEPGIQPEIKVRPIKQVAPGVGVQTVDVRIPTEEMETQTATPSSAAATTTTTGAASVEVQTDPWLPAAAVAAAPRSRGRKRNYPAASALMPQYALHPSIAPTPGYRGYSYRPRRSVGTRGRRRRATTTTRRRRRRRQPVLTPVSVRKVARSGSTLVVPRARYHPSIV

SEQ ID NO: 172 - protein, 250 aa, Ape adenovirus AH16
MEDINFASLAPRHGSRPFMGDWTDIGTSSMSGGAFSWGSLWSGLKNFGSTIKNYGNKAWNSSTGQLLRDKLKEQNFQEKVAQGLASGISGVVDIANQAVQKKINSHLDPRPPVEETPPALETVSPEGKGEKRPRPDREETLVSHIEEPPSYEEAVKAGLPTTRPIAPMATGVVGHRQHTPATLDLPPPSEPPRQPKAATVPAPSTSAANRVSLRRTAGAPRGPRLSGNWQSTLNSIVGLGVKSVKRRRCY

SEQ ID NO: 173 - protein, 204 aa, Ape adenovirus AH16
MSILISPSNNTGWGLRAPSKMFGGARKRSEQHPVRVRGHYRAPWGAHKRGRTGRTTVDDVIDSVVEQARHYTPGAPTAPAVSTVDQAINSVVQGARRYANLKSRRRRVARRHRRRPRAAAAAAARLAKALLKRARRTGHRAAMRAARRAAAAASAATPRTRRRAAAAAAAAISNLASTRRGNIYWVRDSVTGTRVPVRFRPPRN

SEQ ID NO: 174 - protein, 227 aa, Ape adenovirus AH16; identical to SEQ ID NO: 72

SEQ ID NO: 175 - protein, 77 aa, Ape adenovirus AH16
MALTCRLRFPVPGYRGRTHRRRGMAGSGLRGGRRHRRRAKSRRMRGGVLPLLIPLLAAAIGAVPGIASVALQASQKH

SEQ ID NO: 176 - DNA, 37200 bp, Ape adenovirus AH35
catcatcaataatataccttattttggattgtggccaatatgataatgaggtgggcggggcgggtgacgtaggacgcgcgagtggggttgggaggtgtggcggaagcgtggcatttgcaagtgggaggagctcacatgcaagcttccgtcgcggaaaatgtgacgtttttaatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatctgacgcggagggtatttaaacccgctgcgctcctaaagaggccactcttgagtgccagcgagaagagttttctcctccgctccgtttcggcgaacgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcctaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagttttttgcgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggacaaggaaattaccttccattttgtgcaagcctaagacacctgtgaggaccagcgaggcggacagcactgactctggcacttctacctctcctcctgaaattcacccagtggttcctttgggtatacataaacctgttgctattaaagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattaacatgacgcccaatgtttgcttttgaatgacttcatgtgtataataaaagtgagtgtggtcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtctccagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgccgcggcaggggctgaggtttcccgaccatcgccaacatcagaatctggaagacgagccggaggagcgagcggaggagaagatcagcttgagggccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataacccgccaccgaccggaatgtattacctatcagcagattaaggagagttgtgccaacgagctggatcttttgggtcagaagtatagcatagaacagcttaccacttactggcttcagcccggggatgattgggaagaggcgatcagggtgtatgcaaaggtggccctgcggcccgattgcaagtataagattactaagttggttaatattagaaactgctgctatatttctgggaacggggccgaagtggagatagatactgaggacagggtggctattaggtgttgcatgataaacatgtggcccgggatactggggatggatggggtgatatttatgaatgtaaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaacttcagccacactaaaatcctgctggaacccgagtgcatgaccaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagtagggtgggcgtgtataaattgggggtctaaggggtctctctgtttgtcttgcaacagccgccgccatgagcgacaccggcaacagctttgatggaagcatctttagcccctatctgacagtgcgcatgcctcactgggccggagtgcgtcagaatgtgatgggttccaacgtggatggacgtcccgttttgccttcaaattcgtctacgatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctttggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagctgggaggggtgcatccggggggatatgatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctgggatcgctcacatcgtagttatgttccagggtgaggtcatcataggacatctttacaaatcgggggcggagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagagtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgcgcagaccgtctcgcattccaccagccaagtgagttccgggcggtcagggtcaaaaaccaggctgcccccatgctttttgatgcgtttcttacctcggctctccatgaggcggtgtcccttctcggtgacgaagaggctgtccgtgtccccgtagaccgacttcaggggcctgttttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctttcaaaggcgggcatgacctcagcgctcaggttgtcagtttctaaaaatgaggaggatttgatgttcacctgtccggaagtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtattcgcgggccacgcacttccactcggggaagacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagttcgtgggagggggccagcatgttgggcccgaggttggtgcgctgggggcgctcggcgcggaagacgatctgcctgaagatggcatgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcgcagtagtcgagggtctcacggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctaaccatgactttgaggtattgatgtctgaagtctgtgtcatcgcagccgccctgttcccacagggtgtagtccgtgcgctttttggagcgcgggttgggcagggagaatgtgaggtcattgaagaggatttttcctgctcgaggcatgaagtttctggtgatgcgaaagggccctgggaccgaggagcggttgttgatgacctgggcggccaggacgatctcgtcaaagccgtttatgttgtggcccacgatgtagagctccaggaagcggggctggcccttgatggaggggagctttttaagttcctcgtaggtgagctcctcgggcgattccaggccgtgctcctccagggcccagttttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgtgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggtttacctcgcagagacgggtcaacgcacgggcagtgttaagatggtatctgatttcaaggggcgtgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggactggagggggcggcggcgggggaggggcgcggcggcggcggcggcgcaccgggagacggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcctctacccgccccggtcaccacggccgcggcggccgtgtccggcgcggggggcgcgctggagtcagatgagccaccgcggcggcgacctaggcagtatctggacttggaagagggcgagggactggcgcggctgggggcgagctccccagagcgccacccgcgggtgcagttaaaaagggacgcgcgcgaggcgtacctgccgcggcagaacctgtttcgcgaccgcgggggcgaggagcccgaggagatgcgagactgcaggttccaagcagggcgcgagctgcgccgcgggttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgatcgcgagctgatgcacagtctgcaacgcgcgctcaccggcgcgggcgagggcgacagggaggtcgagtcctacttcgacatgggggccgacctgcactggcagccgagccgccgcgccctggaggcggcgggggcgtatggcggccccctggcggccgatggcgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggagacttcgaggtgcccgaggtcaatgatgggttcctctgggatgacatggatgacagtgtgttctcccccaacccgctgcgcgccgcgtctctgcgactgaaggagggctctgacagggaaggaccgaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaacgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggatctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaactttcgtctgggctgggaccccgtgaccgggctggtcatgccgggggtctacaccaacgaggcctttcatcccgatatagtgctcctgcccggctgtggggtggactttacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggtggcagcgcgtcggtagaaaacgaaagtactcccgcagtggcggcagacgctgcggaggtcgagccggaggccatgcagcaggacgcagaggagggcgcacaggagggcgcgcaggaggacatgaacgatggggagatcaggggcgacactttcgccacccggggcgaagaaaaagaggcagaggcggtggcggcgacggtggaagccgaaaccgaggcagaggcagagcccaagaccgaagttatggaagacatgaatgatggagaacgtaggggtgacacgtttgccacccggggcgaagagaaggcggcggaggcagaagccgcggctgaggaggcggctgcggctgcggccgaggctgaggctgcggctgaggctaaggtcgaagccgatgttgcggttgaggctcaggctgaggaggaggaggcggcgactgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtattggtcgctgccaaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaatacatctaccctcacgcttcaaaatcatgtccgtactcatctcacccagcaacaacaccggctgggggctgcgcgcgcccagcaagatgtttggaggggcgaggaaacgctccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgagagcgtggtacagggcgcgcggcactatgccaaccttaaaaatcgacgccgtcgcgtggctcgccgccatcgccggagaccccgggccaccgccgccgcgcgccttgctaaggctctgctcaggcgcgccaggcgaactggccgccgggccgccatgagggccgcacggcgggctgccgccagcgcggccgccgcggccccacgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgctttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttgaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctagccgccgccgccccggccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacattgctaaccaggccgtgcagaaaaagataaacagtcatctggacccccgccctcaggtggaggaaacgcctccagccatggagacggtgtcttccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcgacactagatctgcccccgccgtccgagccgactcgccagccaaaggcggtgacggtgcccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccactttcaagccctactcgggcactgcctacaactccctggcccccaagggcgcccccaattcttgtgagtgggaacaagatgaaccagctcaggcagcaatagctgaagatgaagaagaacttgaagaagaacaagctcaggacgaacaggcgcccactaagaaaacccatgtatacgctcaggcacctctttctggtgaaaaaattactaaggatggtttgcaaataggtgtggatgccacacaggcgggagataaccctatatatgccgataaaacattccaacccgaacctcagataggtgagtctcagtggaacgaggctgatgccgcagtagcaggaggcagagtcttgaaaaagaccacccctatgagaccttgctatggatcctatgccaagcctactaatgccaacggcggtcaagggatcatggtggccaatgatcagggagcgcttgaatctaaagtcgagatgcaatttttctccaccacaacgtctcttaatgtaagggaaggtgaaaacaatcttcagccaaaagtagtgctgtacagcgaagatgttaacttggaatcccctgacactcatttgtcttacaaacctaaaaaggatgacaccaactctaaaatcatgttgggtcagcaagccatgcccaatagacccaaccttattggatttagagataattttattgggctcgcgtactacaacagcactggtaacatgggagtgctggcgggtcaagcctctcagttgaatgctgtggtggacttgcaagatagaaacacagaactgtcgtaccagcttttgcttgattccattggggatagaaccagatacttttccatgtggaaccaggcagtggatagctatgacccagatgtcagaatcattgaaaaccatggggttgaggatgagctgcccaactactgctttcccctgggcggtattggaattacagacacataccagtgcataaaaccaaccgcagctgctaataacactacatggtccaaggatgaagaatttagtgatcgcaatgaaataggggtgggaaacaacttcgccatggagatcaacatccaggccaacctctggagaaacttcctctatgcgaacgtgggactctacctgccagacaagctcaagtacaaccccaccaacgtggacatctctgacaaccccaacacctatgactacatgaacaagcgggtggtggcccccggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgcccttccacatccaggtaccccagaagttctttgccatcaagaacctcctcctcctgcccggctcctacacctacgagtggaacttcaggaaggatgtaaacatggtcctacagagctctctgggcaacgaccttagggtagatggggccagcatcaagtttgacagcatcaccctctatgctacatttttccccatggcccacaacaccgcctccacgctcgaggccatgctgagaaacgacaccaacgaccagtccttcaatgactacctctctggggccaacatgctctacccaatcccagccaaggccaccaacgtgcccatctccattccctctcgcaactgggccgccttcagaggctgggcctttacccgccttaagaccaaggagaccccctccctgggctcgggttttgatccctactttgtctactcgggatccatcccctacctggatggcaccttctacctcaaccacactttcaagaagatatccatcatgtatgactcctccgtcagctggccgggcaacgaccgcctgctcacccccaatgaattcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtagacgagaccaaatacaaggactatcaggccattggtatcacccaccagcacaacaactcgggtttcgtgggctacctggcacccactatgcgcgagggacaggcctaccccgccaacttcccctaccccttgataggcaagaccgcggtcgacagcgtcacccagaaaaagttcctctgcgaccgcaccctctggcgcattcccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgcctgcatgactggttccaccgagcaagagctcagggccatcgccagagacctgggatgcggaccctactttttgggcacctatgacaaacgcttcccgggtttcatctcccgagacaagctcgcctgcgccatcgtcaacacggccgcgcgcgagaccgggggcgtgcactggctggcctttggctgggacccgcgctctaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgcgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactgattcgcgggacagctggcatcgtgcaggcagcagcgcgcgtcggtgttggcgatctgcaccacgttgcggccccaccggttcttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgcttttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggcaccagggcctcgtcgccctcggactcttcctctgactccaggcggcggcggagtcgcttctttgggggcgcgcgcgtcagcggcggcggagacggggacggggacggggacgggacgccctccacagggggcggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctaccgccgacgcgcccgccacaccgagcgacacccccgcggacccccccgccgacgcacccctgttcgaggaagcggccgtggagcaggacccgggctttgtctcggcagaggaggatttgcaagaggaggaggataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctaatcatgcgccgcggccggcccctcgctccagatgcaaacttgcatgaggagaccgaggacggtcagcccgtggtcagcgacgagcagctggcgcgctggctggagagcgcggaccccgccgaactggaggagcggcgcaagatgatgatggccgcggtgctggtcaccgtagagctggagtgtctgcagcgcttcttcggcgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgcctcgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgtcccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagagtttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacacgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggaaaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccggcggcagcggcgcccgtttcggtgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaggattactccacccgcatgaactggctcagtgccggcccacacatgatctcacaggttaatgacatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagtttacagcccgtcccctactggcggagttggaaaaggggccttctatcctaaccattgcctgcatctgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggtccctgcacccacacccacctgttgatcgtaaacgactctcttccgagaacagacctcaataactcctctccgcagttccccagaacaggaggtgagctcaggaaaccccgggtaaaaaagggtggacaagagttaacacttgtggggtttctggtgtatgtgacgctggtggtggctcttttgattaaggcttttccttccatgtctgaactctccctcttcttttatgaacaactcgactagcgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataaacatgctactgctcgccttccttatcctggcgctggccgcccaatgccaagccttttccgaggctgactttgtagagccccagtgcaacgttacttttagagcctatgcacagcgttgtcatactataatcaaatgtgccaccgaacacaatggataccttattcagtataaagataaatcacacaaagtggcacttgttgacatctgggaacccgaagaccctctggaatacaatgttaccgttttccagggtgacctcttcagaacttacaattacactttcccatttgaccagatgtgtgactttgtcatgtacatggaaaagcagcacaagctgtggcctccaactccccagggctgtgtggaaaatccaggctctttctgtatgatctctctctgtgtaactgtgctggcactaatactcacgcttctgtatctcagatttaaatcaaggcaaagctttattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatgattaattactggagaccccacagagattacatgcttcacgtagtaaagggtcccattaacagcccaaccaccacctctaccacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccgaccttcctccaccttcccagaagccaagtttcctgggggaaaatgaaactttgcctctctccatactcgctctgacatctgttgctattttggccgctctgctggtgcttctatgctctatatgctacctgatctgctgcagaaagaaaaaatctcacggccatgctcaccagccccttatgcacttcccttaccctccagagctgggcgaccacaaactttaagtctgcagtagctatttgcccatcccttgtcagtcgacagcgatgagccccactaatctaacggcctatggacttacaacattgtctcttaatgagaccaccgctcctcaagacctgtacgatggtgtctccgcgctggttaaccagtgggatcgcctgggcatatggtggctccttataggagcagtgaccctgtgcctaatcctggtctggatcatctgctgcatcaaaagcagaaaacccaggcggcggcccatctacaggccctttgtcatcacacctgaagatgatgatgacaccacctccaagctgcagaggctaaagcagctactcttctcttttacagcatggtaaattgaatcatgccccgcattttcatctacttgtctctccttccactttttctgggctcctctacattggccgctgtgtcccacatcgaggtagactgcctcacacccttcacagtctacctgcttttcggctttgtcatctgcacctttgtctgcagcgttattactgtagtgatctgcttcatacagtgcatcgactacatctgcgtgcgggtggcctactttagacaccacccccagtatcgcaacagggacatagcggctctcctaagacttgtttaaaattatggccaaattaactgtgattggtcttctgatcatctgctgcgtcctagccgcgattgggactactcaacctaataccaccaccagcgctcccagaaaaagacatgtatcctgcagcttcaagcgtccctggaatataccccaatgctttactgatgaacctgaaatctctttggcttggtacttcagcgtcaccggccttctcatcttctgcagtacggttattgcccttgccatttatccttcccttaacctgggctggaatgctgtcaactctatggaatatcccaccttcccagaaccagacctgccagacctggttgttctaaacgcgtttcctcctcctcctccagttcaaaatcagtttcgccctccgtccccgacgcccactgaggtcagctactttaatctaacaggcggagatgactgaaaacctagacctagaaatggacggcctctgcagcgagcaacgcacactagagaggcgccggcaaaaagcagagctcgagcgtcttaaacaagagctccaagacgcggtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtgacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagcctctgtccaattttttcagcaacacttccttcccctcttcccaactctggtactctaggcgcctcctagctgcaaacttcctccacagtttgaagggaatgtcagattcctcctcctcctgtccctccgcacccacgatcttcatgttgttgcagatgaaacgcgcaagatcgtctgacgagaccttcaaccccgtgtacccctacgataccgagatcgctccgacttctgtccctttccttacccctccctttgtgtcatccgcaggaatgcaagaaaatccagctggggtgctgtccctgcacctgtcagagccccttaccacccacaatggggccctgactctaaaaatggggggcggcctaaccctggacaaggaagggaatctcacttcccaaaacatcaccagtgtctatccccctctcaaaaaaagcaaaaacaacatcagccttcagaccgccgcacccctcgccgtcagctccggggccctaaccctttttgccactccccccctagcggtcagtggcgacaaccttactgtgcagtctcaagcccctctcactttggaagactcaaaactaactctggccaccaaaggacccctaactgtgtccgaaggcaaacttgtcctagaaacagaggctcccctgcatgcgagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctatcgccgctcttaaaggtagccttgtgccaatcactagtgcaatcagtgtggttcaggtatacctaaggtttgatgaaaatggggtactgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtttacatgaatggggacaatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattcaaatagagcttaatgaaactgcatgagaacccttccacatagcttaaattatcaccagtgcaaatggagaaaaatcaacatacctttttatccagatatcaaagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcaactctttcaagttcacgtcgctgtccaactgctgaagcgctcgcggctccgactgcgcctctagcggaggcaacggcaacacccgatccttgatctataaaggagtagagtcataatcccccatgagaatagggcggtgatgctgcaacaaggcgcgcagcaactcctgccgccgcctttccgtacgacaggaatgcaacggggtggtggtctcctccgcgataatccgcaccgctcgcagcatcagcctcctcgtcctccgggcacaacagcgcatcctgatctcactgagatcggcgcagtaagtgcagcacaacaccaagatgttatttaagatcccacagtgcaaagcactgtacccaaagctcatggcgggaaggacagcccccacgtgaccatcataccagatcctcaggtaaatcaaatgacgacctctcatgaacacgctggacatgtacatcacctccttgggcatgtgctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagaatcatgccaaagggaacagcggacgtactcatatttcctccagcagaaccaagtgcgcgcgtggcagctatccttgcgtcttctgtctcgccgcctgccccgctcggtgtagtagttgtaatacagccactccctcagaccgtcaaggcgctccctggcgtccggatctataacaacaccatcctgcagcgccgccctgatgacatccaccaccgtagagtatgccaagcccagccaggaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcgaaaatagcaaactacatttcccacatgtacaaaaccgaaacccctccccttgtcaccgcccacaacttacatcatcacaaacgtcaaagcctacgtcacccgccccgcccacctcattatcatattggccacaatccaaaataaggtatattattgatgatg

SEQ ID NO: 177 - protein, 836 aa, Ape adenovirus AH35
MQVEKEESLTTPSETADAPAVAVAPATADAPATPSDTPADPPADAPLFEEAAVEQDPGFVSAEEDLQEEEDKEEKPSVPKDHKEQDEHDADAHQGEVGRGDGGHGGADYLDEGNDVLLKHLHRQCAIVCDALQERSEVPLSVAEVSRAYELSLFSPRVPPRRRENGTCEPNPRLNFYPAFVVPEVLATYHIFFQNCKIPISCRANRSRADKMLALRQGDHIPDIAALEDVPKIFEGLGRNEKRAANSLQQENSENESHTGALVELEGDNARLAVLKRSIEVTHFAYPALNLPPKVMNAVMDGLIMRRGRPLAPDANLHEETEDGQPVVSDEQLARWLESADPAELEERRKMMMAAVLVTVELECLQRFFGDPEMQRKVEETLHYTFRQGYVRQACKISNVELSNLVSYLGILHENRLGQSVLHSTLRGEARRDYVRDCVYLFLCYTWQTAMGVWQQCLEERNLKELEKLLQRALKDLWTGFNERSVAAALADLIFPERLLKTLQQGLPDFTSQSMLQNFRNFILERSGILPATCCALPSDFVPLVYRECPPPLWGHCYLFQLANYLSYHADLMEDSSGEGLMECHCRCNLCTPHRSLVCNTQLLSESQIIGTFELQGPSSSDEKSAAPGLKLTPGLWTSAYLRKFVPEDYHAHEIRFYEDQSRPPKAELTACVITQGEILGQLQAIQKARQEFLLRKGRGVYLDPQSGEELNPVPPLPPPRDLASQDKHRHGSQKEAAAAATAATPHAGGRGGILGQSGRGGFGRGGAGDGDGRVGGGQLRRGGFRSRRGRRNTVTLGRSPLAGAPEVRSQHQQQQQRYNLRSSTAATHGRPQTQP

SEQ ID NO: 178 - protein, 203 aa, Ape adenovirus AH35
MRADREELDLPPPVGGLAVDVVKVEVPSAGRALVLAFVKATAVLAALHGLYILHEVNLATSDEEAQRESKSPAWGPVWLVVFYFGCLAASICLLEGDGGTDHHAARAAGPDLGARRAEFDDDIAHIGAVHGLQLPRRQVSREFLEVYLAETGQRTGSVKMVSDFKGRVGGGVDGLQEAAAPGGHDGSPRGARGGGSWGCVQKR

SEQ ID NO: 179 - protein, 199 aa, Ape adenovirus AH35
MAPRKKQQRPPLPPPHTLEEEEEYWDSQAEEVSDEEEPETEMEEWEEDSLDEEASEAEEAGATPSPSAAAPSQAPPKSAPSISSNSSAITSAPPPPRPTADRRPNRRWDTTGTGAGKSSGKGKQAQRQGYRSWRAHKNAIVACLQDCGGNISFARRFLLFHHGVAFPRNVLHYYRHLYSPYCGGSEPEAAGGSGARFGA

SEQ ID NO: 180 - protein, 189 aa, Ape adenovirus AH35
MAPRKKQQRPPLPPPHTLEEEEEYWDSQAEEVSDEEEPETEMEEWEEDSLDEEASEAEEAGATPSPSAAAPSQAPPKSAPSISSNSSAITSAPPPPRPTADRRPNRRWDLRLTVNEPLSTRELRNRIFPTLYAIFQQSRGQDQELKVKNRSLRSLTRSCLYHKSEDQLRRTLEDAEALFSKYCALTLKD

SEQ ID NO: 181 - protein, 408 aa, Ape adenovirus AH35
MHPVLRQMRPSPRPDQQQQQQACRPPSPLPAPVTTAAAAVSGAGGALESDEPPRRRPRQYLDLEEGEGLARLGASSPERHPRVQLKRDAREAYLPRQNLFRDRGGEEPEEMRDCRFQAGRELRRGLDRQRLLREEDFEPDTQTGISPARAHVAAADLVTAYEQTVNQERNFQKSFNNHVRTLVAREEVTLGLMHLWDLVEAIVQNPSSKPLTAQLFLVVQHSRDNEAFREALLNITEPEGRWLLDLINILQSIVVQERSLSLAEKVAAINYSMLSLGKFYARKIYKTPYVPIDKEVKIDSFYMRMALKVLTLSDDLGVYRNERIHKAVSASRRRELSDRELMHSLQRALTGAGEGDREVESYFDMGADLHWQPSRRALEAAGAYGGPLAADGEEEEDYELEEGEYLED

SEQ ID NO: 182 - protein, 548 aa, Ape adenovirus AH35
MASRDQDQREKTPERGRGSARRPPPVEGVPSPSPSPSPPPLTRAPPKKRLRRRLESEEESEGDEALVPRTPSPTPSTSVAVADSIAAAPKKKKKRSAAFAAERRSPSPEIVVDSEDEEEQAALTMVGFSNPPVLIKQVKGGKRSVRRLPEDDPLVQAVKARNSGGARREEGEEEEIESTVSSPLEVINPLSLPMVSAWEKGMEAARAMMDKYHVDNDLKTNFKMLPEQTEALAAICKTWLNEEHRGLQLTFTSQKTFMTMMGRFLQAYLQAYAGVTHKNWEPTGCALWEHRCTQTEGDLKCLHGTNMINKEQVIEMDVTSENGQRALKEQASKAKIVKNRWGRNVVQIANTDARCCLHDASCPANQFSSKSCGMFFSEGAKTQVAFRQIEAFMRALYPQAQSGRGHLLMPLRCDCNGKPGLPPFLGRQVCKMTPFALSNAEDLDSDMISDESLLASVNNPALLVFQCCNPVYRNSRAQGSGPNCDFKISAPDLLSALQLTRTLWSENFPEEPLPRMVVPEFKWASRFQYRNVSLPVAHGDARQNPFDF

SEQ ID NO: 183 - protein, 185 aa, Ape adenovirus AH35
MEAWGCLEEFADVRRLLDESSSNTYSIWRYLWGSTQAKLVSRIKQDYKCDFEELFSSCGELLQSLNLGHQAIFQEKVLSTLDFSTPGRTAACVAFVSFVQDKWSGETHLSHGYVLDFMAMALWRAYNKWKIQKELYGSALRRPLLPRQGLRFPDHRQHQNLEDEPEERAEEKISLRAGLDPPQEE

SEQ ID NO: 184 - protein, 504 aa, Ape adenovirus AH35
MERGDPPESRLRAGFHGDGSLEGLQQMEDSEGTVRFRPTSSTSAAAGAEVSRPSPTSESGRRAGGASGGEDQLEGRPGPSSGGMNLPQVVELFPELRRVLTIREDGQFVKKLKRDRGEGDDEAASNLAFSLITRHRPECITYQQIKESCANELDLLGQKYSIEQLTTYWLQPGDDWEEAIRVYAKVALRPDCKYKITKLVNIRNCCYISGNGAEVEIDTEDRVAIRCCMINMWPGILGMDGVIFMNVRFTGPNFNGTVFMGNTNLLLHGASFYGFNNTCIEAWTDVKVRGCSFYSCWKAVVCRPKSRGSVKKCLFERCTLGILSEGNSRVRHNVASNCGCFMQVKGVSVIKHNSVCGNCEDRASQMLTCFDGNCHLLKTIHISSHPRKAWPVFEHNILTRCSLHLGVRRGMFLPYQCNFSHTKILLEPECMTKVSLNGVFDVSLKIWKVLRYDETRTRCRPCECGGKHMRNQPVMLDVTEELRPDHLVLACTRAEFGSSDEDTD

SEQ ID NO: 185 - protein, 107 aa, Ape adenovirus AH35; identical to SEQ ID NO: 151

SEQ ID NO: 186 - protein, 128 aa, Ape adenovirus AH35; identical to SEQ ID NO: 152

SEQ ID NO: 187 - protein, 161 aa, Ape adenovirus AH35
MLLLAFLILALAAQCQAFSEADFVEPQCNVTFRAYAQRCHTIIKCATEHNGYLIQYKDKSHKVALVDIWEPEDPLEYNVTVFQGDLFRTYNYTFPFDQMCDFVMYMEKQHKLWPPTPQGCVENPGSFCMISLCVTVLALILTLLYLRFKSRQSFIDEKKMP

SEQ ID NO: 188 - protein, 77 aa, Ape adenovirus AH35
MALTCRLRFPVPGYRGRTHRRRGMAGSGLRGGRRHRRRAKSRRMRGGVLPLLVPLLAAAIGAVPGIASVALQASQKH

SEQ ID NO: 189 - protein, 90 aa, Ape adenovirus AH35; identical to SEQ ID NO: 155

SEQ ID NO: 190 - protein, 142 aa, Ape adenovirus AH35; identical to SEQ ID NO: 156

SEQ ID NO: 191 - protein, 294 aa, Ape adenovirus AH35
MSTSAVPFGMILRSTRSRLSRHCPYTRDRLPPFETETRASVMEDHPVFPDCDTLTMHNVSYVRGLPCCVGFTLIQEWVIPWDMVLTREELLIMKKCMKVCLCCANVDIMTSSMVHGYERWSLHCHCDSPGSLQCLAGGQVLASWFRMVLEGSLINQRCLWYREVVNQHMPKEVMYMSSVFMRGRHLIYLRIWYDGHVGAVLPAMSFGYSALHCGILNNILVLCCTYCADLSEIRMRCCARRTRRLMLRAVRIIAEETTTPLHSCRTERRRQELLRALLQHHRPILMGDYDSTPL

SEQ ID NO: 192 - protein, 127 aa, Ape adenovirus AH35; identical to SEQ ID NO: 158

SEQ ID NO: 193 - protein, 117 aa, Ape adenovirus AH35; identical to SEQ ID NO: 159

SEQ ID NO: 194 - protein, 121 aa, Ape adenovirus AH35; identical to SEQ ID NO: 160

SEQ ID NO: 195 - protein, 130 aa, Ape adenovirus AH35; identical to SEQ ID NO: 161

SEQ ID NO: 196 - protein, 580 aa, Ape adenovirus AH35
MKRARSSDETFNPVYPYDTEIAPTSVPFLTPPFVSSAGMQENPAGVLSLHLSEPLTTHNGALTLKMGGGLTLDKEGNLTSQNITSVYPPLKKSKNNISLQTAAPLAVSSGALTLFATPPLAVSGDNLTVQSQAPLTLEDSKLTLATKGPLTVSEGKLVLETEAPLHASDSSSLGLSVTAPLSINNDSLGLDMQAPISSRDGKLALTVAAPLTVAEGINALAVATGNGIGLNETNTHLQAKLVAPLGFDTNGNIKLSVAGGMRLNNNTLILDVNYPFEAQGQLSLRVGSGPLYVDSSSHNLTIRCLRGLYVTSSNNQNGLEANIKLTKGLVYDGNAIAVNVGKGLEYSPTGTTEKPIQTKIGLGMEYDTEGAMMTKLGSGLSFDNSGAIVVGNKNDDRLTLWTTPDPSPNCQIYSEKDAKLTLVLTKCGSQVVGTVSIAALKGSLVPITSAISVVQVYLRFDENGVLMSNSSLNGEYWNFRNGDSTNGTPYTNAVGFMPNLLAYPKGQTTTAKSNIVSQVYMNGDNTKPMTFTINFNGLSETGDTPVSKYSMTFSWRWPNGSYIGHNFVTNSFTFSYIAQE

SEQ ID NO: 197 - protein, 959 aa, Ape adenovirus AH35
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQDEPAQAAIAEDEEELEEEQAQDEQAPTKKTHVYAQAPLSGEKITKDGLQIGVDATQAGDNPIYADKTFQPEPQIGESQWNEADAAVAGGRVLKKTTPMRPCYGSYAKPTNANGGQGIMVANDQGALESKVEMQFFSTTTSLNVREGENNLQPKVVLYSEDVNLESPDTHLSYKPKKDDTNSKIMLGQQAMPNRPNLIGFRDNFIGLAYYNSTGNMGVLAGQASQLNAVVDLQDRNTELSYQLLLDSIGDRTRYFSMWNQAVDSYDPDVRIIENHGVEDELPNYCFPLGGIGITDTYQCIKPTAAANNTTWSKDEEFSDRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSITLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETKYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 198 - protein, 511 aa, Ape adenovirus AH35
MRDGLRGLRRGRLLPRVRVSRSQALRPEEPAVPLVRRHLQGKAPRQGARRRGSRLRDHGQMLPGRRAGRRAAAIQHQQNQPQAHPGQRPTRSAPLHRDPDHPDEDSAPMEGHDSGPAGRPSAGALQRKPPQPAKRGDLLDRDAVEHITELWDRLELLTQTLKNMPTADGLKPLKNFASLQELLSLGGERLLAELVRENIHVRDMLNEVAPLLREDGSCSSLNYQLQPVIGVIYGPTGCGKSQLLRNLLSSQLISPAPETVFFIAPQVDMIPPSEMKAWEMQICEGNYAPGPEGTIIPQSGTLRPRFVKMSYDDLTLEHNYDVSDPRNVFAQAASHGPIAIIMDECMENLGGHKGVSKFFHAFPSKLHDKFPKCTGYTVLVVLHNMNPRRDLGGNIANLKIQSKMHIISPRMHPSQLSRFVNTYTKGLPLAISLLLKDIFQHHAQRSCYDWIIYNTTPEHEALQWCYLHPRDGLMPMYLNIQSHLYHVLERIHRTLNDRDRWSRAYRARRVK

SEQ ID NO: 199 - protein, 133 aa, Ape adenovirus AH35; identical to SEQ ID NO: 165

SEQ ID NO: 200 - protein, 656 aa, Ape adenovirus AH35
MRRAAMFEEGPPPSYESAMGISPAAPLQPPYVPPRYLQPTGGRNSICYSELQPLYDTTRLYLVDNKSADVASLNYQNDHSDFLTTVIQNNDFTPTEASTQTINLDNRSNWGGDLKTILHTNMPNVNEFMFTNSFKARVMVAREQGEAKYEWVDFTLPEGNYSETMTLDLMNNAIVEHYLKVGRQNGVKESDIGVKFDTRNFRLGWDPVTGLVMPGVYTNEAFHPDIVLLPGCGVDFTQSRLSNLLGVRKRQPFQEGFKITYEDLEGGNIPALLDLDAYEESLKPEESAGDSGESGEEQAGGGGSASVENESTPAVAADAAEVEPEAMQQDAEEGAQEGAQEDMNDGEIRGDTFATRGEEKEAEAVAATVEAETEAEAEPKTEVMEDMNDGERRGDTFATRGEEKAAEAEAAAEEAAAAAAEAEAAAEAKVEADVAVEAQAEEEEAATEAVKEKAQAEQEEKKPVIQPLKEDSKKRSYNVIEGSTFTQYRSWYLAYNYGDPVKGVRSWTLLCTPDVTCGSEQMYWSLPNMMQDPVTFRSTRQVSNFPVVGAELLPVHSKSFYNEQAVYSQLIRQATSLTHVFNRFPENQILARPPAPTITTVSENVPALTDHGTLPLRNSISGVQRVTITDARRRTCPYVYKALGIVSPRVLSSRTF

SEQ ID NO: 201 - protein, 595 aa, Ape adenovirus AH35
MQDPNVADPAVRAALQSQPSGINSSDDWAAAMGRIMALTARNPEAFRQQPQANRLAAILEAVVPARSNPTHEKVLAIVNALAESRAIRADEAGLVYDALLQRVARYNSGNVQTNLDRLVTDVREAVAQRERLHQDGNLGSLVALNAFLSTQPANVPRGQEDYTNFLSALRLMVTEVPQSEVYQSGPDYFFQTSRQGLQTVNLSQAFKNLRGLWGVKAPTGDRATVSSLLTPNSRLLLLLIAPFTDSGSVSRETYLGHLLTLYREAIGQAQVDEHTFQEITSVSHALGQEDTGSLQATLNYLLTNRRQKIPTLHSLTQEEERILRYVQQSVSLNLMRDGVTPSVALDMTARNMEPGMYASQRPFINRLMDYLHRAAAVNPEYFTNAILNPHWMPPPGFYNGDFEVPEVNDGFLWDDMDDSVFSPNPLRAASLRLKEGSDREGPRSLASSLALGAVGATGAAARGSSPFPSLADSLNSGRVSRPRLLGEEEYLNNSLLQPVRDKNAQRQQFPNNGIESLVDKMSRWKTYAQEYKEWEDRQPRPLPPPRQRWQRRASNRRWRQGPEDDDDSADDSSVLDLGGSGNPFSHLRPRLGKMF

SEQ ID NO: 202 - protein, 1060 aa, Ape adenovirus AH35
MALVMDSSNVRDVVIKLRPPSAEIWTCGSRGVVVCSTIALQETDAGGQTTKVKDHQPHGTPGGGLRFPLRFLVRGRQVHLVQDIQPVQRCQYCGRFYKSQHECSARRRDFYFHHINSQSSNWWREIQFFPIGSHPRTERLFVTYDVETYTWMGAFGKQLVPFMLVMKLGGDEALVAAARDLARELRWDPWEKDPLTFYCITPEKMAVGRQFRTFRDRLQTLMARDLWRSFLAANPHLQNWALEEHGLESPEELTYEELKKLPSIKGQPRFLELYIVGHNINGFDEIVLAAQVINNRSSVPGPFRITRNFMPRAGKILFNDLTFSLPNPRSKKRTDYTLWEQGGCDDTDFRHQYLKVMVRDTFALTHTSLRKAAQAYALPVEKGCCPYQAVNQFYMLGSYRSDTDGFPLQEYWKDREEFVLNRELWKKKGEDKYDIIRETLDYCALDVQVTAELVHKLRESYASFVRDSVGLQEASFNVFQRPTISSNSHAIFRQIVFRAERPQRTNLGPNMLAPSHELYDYVRASIRGGRCYPTYLGILREPLYVYDICGMYASALTHPMPWGPPLNPYERALAAREWQRALDMQACKIDYFDPRLLPGVFTIDADPPNEDQLDPLPPFCSRKGGRLCWTNERLRGEVATSVDMVTLHNRGWRVRLIPDERTTVFPEWKCVAREYVQLNIAAKERADRDKNQTLRSIAKLLSNALYGSFATKLDNKKIVFSDQMDPGTLKGITSGQVNIKSSSFLETDNLSAEVMPAFEREYLPQQLALADSDAEESEDERAPTPFYTPPSGTPGHVSYTYKPITFLDAEEGDMCLHTLEKVDPLVDNDRYPSHVASFVLAWTRAFVSEWSEFLYEEDRGTPLENRPLKSVYGDTDSLFVTEKGHRLMESRGKKRIKKHGGSLVFDPDRPELTWLVECETVCAACGADAYSPESVFLAPKLYALKSLQCPSCGATSKGKLRAKGHAAEGLDYETMVKCYLADAQGEERQRFSTSRTSLKRTLASAQPGAHPFTVTQTTLTRTLRPWKDMTLAPLDAHRLVPYSESRPNPRNEEICWIEMP

SEQ ID NO: 203 - protein, 210 aa, Ape adenovirus AH35
MTGSTEQELRAIARDLGCGPYFLGTYDKRFPGFISRDKLACAIVNTAARETGGVHWLAFGWDPRSKTCYLFDPFGFSDQRLRQIYEFEYEGLLRRSALASSPDRCITLEKSTETVQGPHSAACGLFCCMFLHAFVHWPQSPMDCNPTMNLLKGVPNAMLQSPQVQPTLRRNQEQLYRFLERHSPYFRSHSARIRGATSFCHLQENMQDGK

SEQ ID NO: 204 - protein, 639 aa, Ape adenovirus AH35
MALMEHFSPLRNIWNRVRDYARATTTAAGITWMSRYIYGYHRLMLEDLAPGAPATQRWPLYRQPPPHFLVGYQYLVRTCNDYVFDSRAFSRLRYTELSQPGHQTVNWSVMANCTYTINTGAYHRFVDMDDFERTLTQVQQAILAERVVADLALLQPLRGFGVTRMGGARNHRRDGEEEGEEVPVERLMQDYYKDLRRCQNEAWGMADRLRIQQAGPKDMVLLSTIRLLKTAYFNYIISSISARNSPDPPPPATVLSLPCDCDWIDAFLQRFSDPVDLDSIRSLGGVPTQQLLRCIVSAVSLPHGRPPRGEMRGGVFELRPRENGRAVTETMRRMRGEMIERFIDRLPVRRRRRRAPPPPPPPPVPAEEEEEAIMEEEVEEEEAPPVAFEREVRDTVAELIRLLEEELTVSARNSQFFNFAVDFYEAMERLEALGDINESTLRRWVMYFFVAEHTATTLNYLFQRLRNYAVFTRHVELNLAQVVMRARDAEGGVVYSRVWNEGGLNAFSQLMGRISNDLAATVERAGRGDLQEEEIEQFMAEIAYQDNSGDVQEILRQAAVNDAEIDSVELSFRFKVTGPVVFTQRRQIQDTNRRVVAHASALRSQHQPLPARGEDVPLPPMPVGPEPPLPPGARPRHRF

SEQ ID NO: 205 - protein, 357 aa, Ape adenovirus AH35
MSKRKIKEEMLQVIAPEIYGPPKKEEDDYKPRKLKRVKKKKKDDDVDEAVEFVRRMAPRRPVQWKGRRVQRVLRPGTAVVFTPGERSTRTFKRVYDEVYGDEDLLEQANHRFGEFAYGKRPRESLKEDLLALPLDEGNPTPSLKPVTLQQVLPLSAPSEQKRGLKREGGDLAPTVQLMVPKRQKLEDVLEKMKVEPGIQPEIKVRPIKQVAPGVGVQTVDVRIPTEEMETQTATPSSAASATTGAASVEVQTDPWLAAAAPAAPRSRGRKRNYPAASALMPQYALHPSIAPTPGYRGYSYRPRRSAGTRGRRRRATTTSRRRRRRRQPVLTPVSVRKVARSGSTLVVPRARYHPSIV

SEQ ID NO: 206 - protein, 250 aa, Ape adenovirus AH35
MEDINFASLAPRHGSRPFMGDWTDIGTSNMSGGAFSWGSLWSGLKNFGSTIKNYGNKAWNSSTGQMLRDKLKEQNFQEKVAQGLASGISGVVDIANQAVQKKINSHLDPRPQVEETPPAMETVSSEGKGEKRPRPDREETLVSHTEEPPSYEEAVKAGLPTTRPIAPMATGVVGHRQHTPATLDLPPPSEPTRQPKAVTVPAPSTSAANRVPLRRAASGPRASRVSGNWQSTLNSIVGLGVRSVKRRRCY

SEQ ID NO: 207 - protein, 202 aa, Ape adenovirus AH35
MSVLISPSNNTGWGLRAPSKMFGGARKRSEQHPVRVRGHYRAPWGAHKRGRAGRTTVDDAIDSVVEQARHYTPGAPSAPAVSTVDEAIESVVQGARHYANLKNRRRRVARRHRRRPRATAAARLAKALLRRARRTGRRAAMRAARRAAASAAAAAPRARRRAAAAAAAAISSLASTRRGNIYWVRDSVTGTRVPVRFRPPRN

SEQ ID NO: 208 - protein, 279 aa, Ape adenovirus AH6
MRHFTYDGGVLTGQLAASVLDALIEEVLADNYPPPAHFEPPTLHELYDLDVVAPSDPNEQAVSSFFPDSMLLASQEGVELETPPPIAVSPEPPTLTRQPDRRVGPATMPHLLPEVIDLTCNESGFPPSEDEDEEGEQFVLDSVEEPGRGCRSCQYHRKNTGDPQIMCSLCYMKTTCMFIYGPVSEPEQEAEPEPESRPRRRPAILTRPSAPVARDLSSAETTDSGPSSSPPEIHPVVPLCPLKPVAVRVSGRRAAVESIEDLLNETQEPLDLSCKRPRQ

SEQ ID NO: 209 - protein, 274 aa, Ape adenovirus AH16
MRHLACTPGLLSGRAASELLDALLNEVLSDDFPSTTHFSPPTLHELYDLDVLVDVNDPNEEAVSTFFPESALLAAQEGFDLHTPPLPILESPLPEPSGIPYMPELLPEVVDLTCHEPGFPPSDDEGEPFALDYAEIPGLGCRSCAYHQRVTGDPEVKCSLCYMRLTSSFIYSPVSEPDPEPDRDPEPDPEPPRRPRKLPSILCKPKTPVRTSEADSTDSGTSTSPPEIHPVVPLGIHKPVAIKVCGRRPAVECIEDLLHDPEEPLDLSFKRPRQ

SEQ ID NO: 210 - protein, 263 aa, Ape adenovirus AH29
MRHLRFLPQEISIETGDEILQFVINALMGDDPEPPAQPFDPPTLHELYDLEVDGPEDPNEEAVNGFFSDSMLLAASEGVDLDPPSETLDTPGVVVESGRGGKKLPELGAAEMDLHCYEEGFPPSDDEDEENVQSIQTAAGEGIRAANDGFKLDYPELPGHGCKSCEFHRNSTGLKELLCSLCYMRTHCHFIYSKCPVSDADESPSPDSTTSPPEIQAPVPANICKPIPVKAKPGKRPAVDKLEDLLEGGDGPLDLSTRKLPRQ

SEQ ID NO: 211 - protein, 263 aa, Ape adenovirus AH34
MRHLRFLPQEISIATGNEILQFVVDALMGDDPEPPAQPFDPPTLHELYDLEVDGPEDPNEEAVNGFFSDSMLLAASEGVDLDPPSETLDTPGVVVESGRGGKKLPELGAAEMDLHCYEEGFPPSDDEDEENVQSIQTAAGEGMKAANDGFKLDCPELPGHGCKSCEFHRNSTGLKELLCSLCYMRTHCHFIYSKCPVSDADESPSPDSTTSPPEIQAPVPANVCKPIPVKAKPGKRPAVDKLEDLLEGGDGPLDLSTRKLPRQ

SEQ ID NO: 212 - protein, 274 aa, Ape adenovirus AH35
MRHLACTPGLLSGRAASELLDALLNEVLSDDFPSTTHFSPPTLHELYDLDVLVDVNDPNEEAVSTFFPESALLAAQEGFDLHTPPLPILESPLPEPSGIPYMPELLPEVVDLTCHEPGFPPSDDEGEPFALDYAEIPGLGCRSCAYHQRVTGDPEVKCSLCYMRLTSSFIYGPVSEPDPEPDRDPEPDPEPPRRTRKLPSILCKPKTPVRTSEADSTDSGTSTSPPEIHPVVPLGIHKPVAIKVCGRRPAVECIEDLLNDPEGPLDLSIKRPRQ

SEQ ID NO: 213 - protein, 262 aa, Ape adenovirus BZ34
MRHLRFLSQEIVSTETGNEILQFVVNTLMGDDPEPPEPSFDPPTLHELYDLEVDGPEDPNEDDVNGFFTDSMLLAANEGVDLDPPSGTLDTPGVIVESDINGKNLPDLGAAELDLHCYEEGFPPSDDEDVENEQSIQTAAGEGVKAASDGFKLDCPMLPGHGCKSCEFHRKNTGVKEILCSLCYMRAHCHFIYSPVSDADESPSPDSTTSPPEIQAPVPANVCKPIPVKLKPGKRPAVDKLEDLLEGVDEPLDLCTRKIPRQ

SEQ ID NO: 214 - protein, 115 aa, Ape adenovirus AH29
MMKTLGILIICCCINFSQLIPTPTSNNVQTTLQNTTNEATSVLLLNNTDLNTNSISKHFLQLQITALIIIGLIILAILLYFVFCRNIPNVHKPIKKRPIYNPILSEPQLRRWREI

SEQ ID NO: 215 - protein, 294 aa, Ape adenovirus AH35; identical to SEQ ID NO: 191

SEQ ID NO: 216 - protein, 130 aa, Ape adenovirus AH35; identical to SEQ ID NO: 161

SEQ ID NO: 217 - DNA, 15 bp, Artificial Sequence
  sequence providing EcoRV and HpaI restriction sites
gatatcgaggttaac

SEQ ID NO: 218 - DNA, 14 bp, Artificial Sequence
  flanking sequence
acgcgtatttaaat

The invention claimed is:

1. An isolated non-human primate adenovirus having a capsid comprising a penton base polypeptide, wherein the penton base polypeptide comprises:

(i) an amino acid sequence having at least 95% identity to SEQ ID NO: 26, or (ii) the amino acid sequence of SEQ ID NO: 26;

wherein the adenovirus is conditionally replicative.

2. An isolated non-human primate adenovirus genome encoding the adenovirus of claim 1.

3. A pharmaceutical composition comprising the adenovirus of claim 1, or the genome of claim 2; and a pharmaceutically acceptable excipient, adjuvant, diluent and/or carrier.

4. A method for targeting a cell having an adenoviral receptor in a subject, the method comprising administering the composition according to claim 3 to the subject.

5. The adenovirus according to claim 1, wherein the capsid comprises a hexon polypeptide comprising the amino acid sequence of SEQ ID NO: 57; and a fiber polypeptide comprising the amino acid sequence of SEQ ID NO: 56.

6. The adenovirus according to claim 1, wherein the capsid comprises a hexon polypeptide comprising the amino acid sequence of SEQ ID NO: 93; and a fiber polypeptide comprising the amino acid sequence of SEQ ID NO: 92.

7. The adenovirus according to claim 1, wherein said adenovirus lacks:

(a) all or a part of an E1 gene; and/or (b) all or part of an E1A gene.

8. The adenovirus according to claim 7, wherein the E1A gene has a Δ24 deletion.

9. The adenovirus according to claim 1, wherein the adenovirus further comprises left-hand and right-hand side adenovirus cis-elements necessary for replication and encapsidation.

10. The adenovirus according to claim 9, wherein the cis-elements necessary for replication and encapsidation comprise an adenovirus left-hand side inverted terminal repeat and an adenovirus right-hand side inverted terminal repeat, and encapsidation signals.

11. The adenovirus according to claim 1, wherein said adenovirus comprises a hexon polypeptide comprising the amino acid sequence of SEQ ID NO: 57 or SEQ ID NO: 93.

12. The adenovirus according to claim 1, wherein said adenovirus comprises a fiber polypeptide, wherein said fiber polypeptide comprises:

(i) the amino acid sequence of SEQ ID NO: 56; or (ii) an amino acid sequence having at least 95% identity to amino acid residues 127 to 320 of SEQ ID NO: 92, amino acid residues 74 to 126 of SEQ ID NO: 92, or amino acid residues 1 to 73 of SEQ ID NO: 92.

13. The adenovirus according to claim 1, wherein said adenovirus comprises a fiber polypeptide, wherein said fiber polypeptide comprises:

(i) the amino acid sequence of SEQ ID NO: 56; or (ii) the amino acid sequence according to amino acid residues 127 to 320 of SEQ ID NO: 92, amino acid residues 74 to 126 of SEQ ID NO: 92, or amino acid residues 1 to 73 of SEQ ID NO: 92.

14. The adenovirus according to claim 1, wherein said adenovirus comprises a fiber polypeptide comprising the amino acid sequence of SEQ ID NO: 56 or 92.

* * * * *